(12) United States Patent
Tian et al.

(10) Patent No.: US 12,252,742 B2
(45) Date of Patent: Mar. 18, 2025

(54) METHODS FOR PROCESSING A NUCLEIC ACID SAMPLE AND COMPOSITIONS THEREOF

(71) Applicant: AXBIO INC., Santa Clara, CA (US)

(72) Inventors: Hui Tian, Cupertino, CA (US); Igor Constantin Ivanov, Danville, CA (US); Vladimir Ivanovich Bashkirov, Davis, CA (US)

(73) Assignee: AXBIO INC., Santa Clara, CA (US)

( * ) Notice: Subject to any disclaimer, the term of this patent is extended or adjusted under 35 U.S.C. 154(b) by 0 days.

(21) Appl. No.: 18/616,750

(22) Filed: Mar. 26, 2024

(65) Prior Publication Data

US 2024/0318246 A1 Sep. 26, 2024

Related U.S. Application Data

(63) Continuation of application No. PCT/US2022/044943, filed on Sep. 27, 2022.

(60) Provisional application No. 63/249,177, filed on Sep. 28, 2021.

(51) Int. Cl.
*C12Q 1/6869* (2018.01)
*C12Q 1/6806* (2018.01)
*C12Q 1/6855* (2018.01)

(52) U.S. Cl.
CPC ......... *C12Q 1/6869* (2013.01); *C12Q 1/6806* (2013.01); *C12Q 1/6855* (2013.01)

(58) Field of Classification Search
CPC . C12Q 1/6869; C12Q 1/6806; C12Q 11/6855
See application file for complete search history.

(56) References Cited

U.S. PATENT DOCUMENTS

| 5,795,782 | A | 8/1998 | Church et al. |
| 6,117,634 | A | 9/2000 | Langmore et al. |
| 6,197,557 | B1 | 3/2001 | Makarov et al. |
| 7,223,541 | B2 | 5/2007 | Fuller et al. |
| 7,238,485 | B2 | 7/2007 | Akeson et al. |

(Continued)

FOREIGN PATENT DOCUMENTS

| CN | 101914620 A | 12/2010 |
| CN | 101965410 A | 2/2011 |

(Continued)

OTHER PUBLICATIONS

Myllykangas et al., "Targeted sequencing library preparation by genomic DNA circularization," BMC Biotechnology, vol. 11, pp. 1-12. (Year: 2011).*

(Continued)

*Primary Examiner* — Young J Kim
(74) *Attorney, Agent, or Firm* — WILSON SONSINI GOODRICH & ROSATI

(57) ABSTRACT

The present disclosure provides methods for processing a nucleic acid sample. For example, a method of the present disclosure may simultaneously process two populations of nucleic acid (NA) templates for two different sequencing modalities: (i) a first population comprising circularized NA templates having a size smaller than a size threshold (e.g., smaller than 2 kilobase (kb)), and (ii) a second population comprising uncircularized NA templates having a size greater than or equal to the size threshold.

26 Claims, 10 Drawing Sheets

Specification includes a Sequence Listing.

(56) References Cited

U.S. PATENT DOCUMENTS

| | | | |
|---|---|---|---|
| 7,476,503 B2 | 1/2009 | Turner et al. | |
| 7,625,701 B2 | 12/2009 | Williams et al. | |
| 7,824,887 B2 | 11/2010 | Lee et al. | |
| 7,968,702 B2 | 6/2011 | Wegener et al. | |
| 7,973,146 B2 | 7/2011 | Shen et al. | |
| 8,133,669 B2 | 3/2012 | Lebedev et al. | |
| 8,153,375 B2 | 4/2012 | Travers et al. | |
| 8,253,174 B2 | 8/2012 | Daniel et al. | |
| 8,461,854 B2 | 6/2013 | Chen et al. | |
| 8,628,940 B2 | 1/2014 | Sorenson et al. | |
| 9,017,937 B1 | 4/2015 | Turner et al. | |
| 9,290,800 B2 | 3/2016 | Turner et al. | |
| 9,322,062 B2 | 4/2016 | Davis et al. | |
| 9,377,437 B2 | 6/2016 | Chen et al. | |
| 9,441,271 B2 | 9/2016 | Li et al. | |
| 9,494,554 B2 | 11/2016 | Davis et al. | |
| 9,533,305 B2 | 1/2017 | Esfandyarpour et al. | |
| 9,587,269 B2 | 3/2017 | Myers et al. | |
| 9,605,309 B2 | 3/2017 | Davis et al. | |
| 9,678,056 B2 | 6/2017 | Turner et al. | |
| 9,709,503 B2 | 7/2017 | Turner et al. | |
| 9,772,323 B2 | 9/2017 | Turner et al. | |
| 9,885,078 B2 | 2/2018 | Jayasinghe et al. | |
| 9,910,956 B2 | 3/2018 | Travers et al. | |
| 10,036,725 B2 | 7/2018 | Chen | |
| 10,190,158 B2 | 1/2019 | Turner et al. | |
| 10,317,392 B2 | 6/2019 | Mager et al. | |
| 10,344,327 B2 | 7/2019 | Akeson et al. | |
| 10,429,375 B2 | 10/2019 | Chen et al. | |
| 10,481,144 B2 | 11/2019 | Turner et al. | |
| 10,570,449 B2 | 2/2020 | Esfandyarpour et al. | |
| 10,612,091 B2 | 4/2020 | Esfandyarpour et al. | |
| 10,640,818 B2 | 5/2020 | Pham et al. | |
| 10,787,705 B2 | 9/2020 | Esfandyarpour et al. | |
| 11,034,998 B2 | 6/2021 | Bashkirov et al. | |
| 11,078,530 B2 | 8/2021 | Jayasinghe et al. | |
| 11,142,793 B2 | 10/2021 | Turner et al. | |
| 11,603,562 B2 | 3/2023 | Deng et al. | |
| 2002/0102586 A1 | 8/2002 | Ju et al. | |
| 2004/0185445 A1 | 9/2004 | Fang | |
| 2006/0019247 A1 | 1/2006 | Su et al. | |
| 2006/0063171 A1 | 3/2006 | Akeson et al. | |
| 2006/0086626 A1 | 4/2006 | Joyce | |
| 2010/0041029 A1 | 2/2010 | Ju et al. | |
| 2010/0127271 A1 | 5/2010 | Daniel et al. | |
| 2011/0005918 A1 | 1/2011 | Akeson et al. | |
| 2011/0318748 A1 | 12/2011 | Davidson et al. | |
| 2012/0021408 A1 | 1/2012 | Ju et al. | |
| 2012/0046176 A1 | 2/2012 | Su et al. | |
| 2013/0261026 A1 | 10/2013 | Gao et al. | |
| 2013/0327644 A1 | 12/2013 | Turner et al. | |
| 2014/0087474 A1 | 3/2014 | Huber | |
| 2014/0134616 A1 | 5/2014 | Davis et al. | |
| 2014/0228223 A1 | 8/2014 | Gnirke et al. | |
| 2014/0295498 A1 | 10/2014 | Turner et al. | |
| 2014/0377743 A1 | 12/2014 | Ju et al. | |
| 2015/0004600 A1 | 1/2015 | Wang et al. | |
| 2015/0259733 A1 | 9/2015 | Li et al. | |
| 2015/0268195 A1 | 9/2015 | Kongsuphol et al. | |
| 2015/0368710 A1 | 12/2015 | Fuller et al. | |
| 2016/0011169 A1 | 1/2016 | Turner et al. | |
| 2016/0021623 A1 | 1/2016 | Guo et al. | |
| 2016/0032236 A1 | 2/2016 | Nivala et al. | |
| 2016/0216233 A1 | 7/2016 | Hovis et al. | |
| 2016/0265048 A1 | 9/2016 | Ju et al. | |
| 2016/0304954 A1 | 10/2016 | Lin et al. | |
| 2016/0376647 A1 | 12/2016 | Travers et al. | |
| 2017/0168040 A1 | 6/2017 | Turner et al. | |
| 2017/0260579 A1 | 9/2017 | Fedorov et al. | |
| 2018/0073071 A1 | 3/2018 | Ju et al. | |
| 2018/0274024 A1 | 9/2018 | Ju et al. | |
| 2018/0355436 A1 | 12/2018 | Shuber et al. | |
| 2019/0226021 A1 | 7/2019 | Esfandyarpour et al. | |
| 2019/0276887 A1 | 9/2019 | Fuller et al. | |
| 2019/0352709 A1 | 11/2019 | Clarke et al. | |
| 2020/0080141 A1* | 3/2020 | Weng | C12Q 1/6865 |
| 2020/0115745 A1 | 4/2020 | Ju et al. | |
| 2020/0181692 A1 | 6/2020 | Oberstrass et al. | |
| 2020/0232024 A1 | 7/2020 | Esfandyarpour et al. | |
| 2020/0232028 A1 | 7/2020 | Esfandyarpour et al. | |
| 2020/0385802 A1 | 12/2020 | Sheikholeslami et al. | |
| 2021/0018486 A1 | 1/2021 | Bajaj | |
| 2021/0069664 A1 | 3/2021 | Sun et al. | |
| 2021/0139971 A1 | 5/2021 | Deng et al. | |
| 2022/0106629 A1 | 4/2022 | Hong et al. | |
| 2022/0396831 A1 | 12/2022 | Ivanov et al. | |
| 2023/0183797 A1* | 6/2023 | Arcot | C12Q 1/6874 506/4 |
| 2024/0076730 A1 | 3/2024 | Deng et al. | |
| 2024/0328990 A1 | 10/2024 | Hong et al. | |

FOREIGN PATENT DOCUMENTS

| | | |
|---|---|---|
| CN | 101199241 B | 2/2012 |
| CN | 101914620 B | 2/2014 |
| CN | 104312914 A | 1/2015 |
| CN | 1973048 B | 6/2015 |
| CN | 101680873 B | 11/2015 |
| CN | 103298984 B | 11/2015 |
| CN | 103695530 B | 5/2016 |
| CN | 105612260 A | 5/2016 |
| CN | 104105797 B | 8/2016 |
| CN | 103717753 B | 12/2016 |
| CN | 104379761 B | 3/2017 |
| CN | 103328981 B | 4/2017 |
| CN | 106796214 A | 5/2017 |
| CN | 107083421 A | 8/2017 |
| CN | 107250780 A | 10/2017 |
| CN | 108350491 A | 7/2018 |
| CN | 105051214 B | 12/2018 |
| CN | 105637082 B | 2/2019 |
| CN | 105273991 B | 5/2019 |
| CN | 109735440 A | 5/2019 |
| CN | 109790575 A | 5/2019 |
| CN | 109891233 A | 6/2019 |
| CN | 109952382 A | 6/2019 |
| CN | 105378113 B | 2/2020 |
| CN | 111187811 A | 5/2020 |
| CN | 104955958 B | 12/2020 |
| CN | 106715453 B | 4/2021 |
| CN | 106591103 B | 6/2021 |
| CN | 107077539 B | 11/2021 |
| EP | 0676623 A2 | 10/1995 |
| EP | 2307540 B1 | 4/2017 |
| EP | 2682460 B1 | 4/2017 |
| EP | 2917372 B1 | 4/2020 |
| JP | 2005509846 A | 4/2005 |
| JP | 2007507689 A | 3/2007 |
| JP | 2011000058 A | 1/2011 |
| RU | 2529784 C2 | 9/2014 |
| WO | WO-03048387 A2 | 6/2003 |
| WO | WO-2012141605 A1 | 10/2012 |
| WO | WO-2013036929 A1 | 3/2013 |
| WO | WO-2013112541 A2 | 8/2013 |
| WO | WO-2013148400 A1 | 10/2013 |
| WO | WO-2014074727 A1 | 5/2014 |
| WO | WO-2014182630 A1 | 11/2014 |
| WO | WO-2015086654 A1 | 6/2015 |
| WO | WO-2015183026 A1 | 12/2015 |
| WO | WO-2017184677 A1 | 10/2017 |
| WO | WO-2018102350 A1 | 6/2018 |
| WO | WO-2018140329 A1 | 8/2018 |
| WO | WO-2018145041 A1 | 8/2018 |
| WO | WO-2018183538 A1 | 10/2018 |
| WO | WO-2018183942 A1 | 10/2018 |
| WO | WO-2019040546 A1 | 2/2019 |
| WO | WO-2019121845 A1 | 6/2019 |
| WO | WO-2019129555 A1 | 7/2019 |
| WO | WO-2019226689 A1 | 11/2019 |
| WO | WO-2021021944 A1 | 2/2021 |
| WO | WO-2023055752 A2 | 4/2023 |

(56) References Cited

FOREIGN PATENT DOCUMENTS

| WO | WO-2024077111 A2 | 4/2024 |
|----|------------------|--------|
| WO | WO-2024086745 A2 | 4/2024 |

OTHER PUBLICATIONS

Daniels, et al. Label-Free Impedance Biosensors: Opportunities and Challenges. Electroanalysis. Jun. 2007;19(12):1239-1257.
EMBOSS. EMBOSS Water: Pairwise Sequence Alignment (Nucleotide). Available at http://www.ebi.ac.uk/Tools/psa/emboss_water/nucleotide.html. Accessed on Oct. 10, 2016.
EMBOSS Needle: Pairwise Sequence Alignment (Nucleotide). Retrieved from Internet URL: https://www.ebi.ac.uk/jdispatcher/psa/emboss_needle. pp. 1-4. Retrieved on May 30, 2024.
European search report and opinion dated Sep. 8, 2023 for EP Application No. 20846062.6.
Fu et al. Sequencing Double-Stranded DNA by Strand Displacement. Nucleic Acids Research. 1997;25(3):677-679.
Fuller, et al. Real-time single-molecule electronic DNA sequencing by synthesis using polymer-tagged nucleotides on a nanopore array. Proc Natl Acad Sci USA. May 10, 2016;113(19):5233-5238. doi: 10.1073/pnas.1601782113. Epub Apr. 18, 2016.
Gao, et al., An Efficient strategy for sequencing-by-synthesis. Journal of Nanoscience and nanotechnology. 2010; 10:2988-2993.
Hutter, et al. Labeled nucleoside triphosphates with reversibly terminating aminoalkoxyl groups. Nucleosides Nucleotides Nucleic Acids. Nov. 2010;29(11):879-95. doi: 10.1080/15257770.2010.536191.
International search report with written opinion dated Apr. 13, 2023 for PCT/US2022/044943.
International search report with written opinion dated Oct. 23, 2019 for PCT/US2019/033376.
International search report with written opinion dated Nov. 9, 2020 for PCT/US2020/044089.
Jovelet et al., "Circulating Cell-free Tumor DNA Analysis of 50 Genes by Next-Generation Sequencing in the Prospective MOSCATO Trial," Clinical Cancer Research, vol. 22, No. 12, pp. 2960-2968. (Year: 2016).
Katz, et al. Probing Biomolecular Interactions at Conductive and Semiconductor Surfaces by Impedance Spectroscopy: Routes to Impedimetric Immunosensors, DNA-Sensors, and Enzyme Biosensors. Electroanalysis 15 (2003): 913-947.
Klein et al. Hybridization Kinetics Explains CRISPR-Cas Off-Targeting Rules. Cell Reports 22:1413-1423 (Feb. 6, 2018).
Kumar et al. PEG-Labeled Nucleotides and Nanopore Detection for Single Molecule DNA Sequencing by Synthesis. Scientific Reports 2:1-8 (2012).
Kumar, et al. Terminal phosphate labeled nucleotides: synthesis, applications, and linker effect on incorporation by DNA polymerases. Nucleosides Nucleotides Nucleic Acids. 2005;24(5-7):401-8.
Lou, et al. High-throughput DNA sequencing errors are reduced by orders of magnitude using circle sequencing. Proc Natl Acad Sci U S A. Dec. 3, 2013;110(49):19872-7. doi: 10.1073/pnas.1319590110. Epub Nov. 15, 2013.
Myadelets, et al. M 99 Histology, cytology and embryology of humans. Part 1. Cytology, embryology and general histology: textbook [in Russian] / O.D. Myadelets—Vitebsk: VSMU, 2014—439 p. 199 (English Machine Translation).
NCBI. Basic Local Alignment Search Tool. BLAST algorithm. Available at https://blast.ncbi.nlm.nih.gov/Blast.cgi. Accessed on Jan. 3, 2017.
NCBI BLAST Results for TAGGGATAACAGGGTAAT *Homo sapiens*. Retrieved from https://blast.ncbi.nlm.nih.gov/Blast.cgi on May 9, 2019. (10 pages).
Nelson J.R. et al. TempliPhi, phi29 DNA polymerase based rolling circle amplification of templates for DNA sequencing. Biotechniques. Jun. 2002; Suppl:44-7. PMID: 12083397.
New England BioLabs Inc. Nt.BspQI Product Information. Retrieved online at https://www.neb.com/products/r0644-ntbspqi#Product%20Information. Accessed May 16, 2019. (8 pages).
Notice of Allowance dated Nov. 9, 2022 for U.S. Appl. No. 16/953,667.
Notice of Allowance dated Nov. 23, 2022 for U.S. Appl. No. 16/953,667.
Office action dated Jul. 8, 2022 for U.S. Appl. No. 16/953,667.
Palla, et al. DNA sequencing by synthesis using 3'-O-azidomethyl nucleotide reversible terminators and surface-enhanced Raman spectroscopic detection. RSC Adv. Jan. 1, 2014;4(90):49342-49346. doi: 10.1039/C4RA08398A.
PCT/US2023/076028 International Invitation to Pay Additional Fees dated Jan. 26, 2024 IPAF Jan. 26, 2024.
PCT/US2023/076028 International Search Report and Written Opinion dated Apr. 10, 2024.
PCT/US2023/077338 International Invitation to Pay Additional Fees dated Jan. 26, 2024.
PCT/US2023/077338 International Search Report and Written Opinion dated Apr. 12, 2024.
Song, et al. CRISPR-Cas9 D10A Nickase-Assisted Genome Editing in Lactobacillus casei. Appl Environ Microbiol. Oct. 31, 2017;83(22):e01259-17. doi: 10.1128/AEM.01259-17. Print Nov. 15, 2017.
Stranges, Benjamin, et al., Design and Characterization of a Nanopore-coupled Polymerase for Single-molecule Dna Sequencing by Synthesis on an Electrode Array. Proceedings of the National Academy of Sciences of the United States of America 113(44):E6749-E6756 (2016).
Thermo Fisher Scientific. User Guide: Ajul, 5 U/uL, 100U. Catalog No. ER1951. 3 pages. (2012).
Thermo Fisher Scientific. User Guide: I-SceI, 10 U/uL, 250U. Catalog No. ER1771. 4 pages. (2016).
U.S. Appl. No. 61/789,354, inventors Pham; Thang Tat et al., filed on Mar. 15, 2013.
U.S. Appl. No. 17/587,643 Office Action dated Dec. 18, 2023.
U.S. Appl. No. 18/164,102 Office Action dated Jan. 18, 2024.
U.S. Appl. No. 17/587,643 Office Action dated Jul. 1, 2024.
U.S. Appl. No. 18/164,102 Notice of Allowance dated Oct. 10, 2024.
U.S. Appl. No. 18/164,102 Office Action dated Jul. 29, 2024.

* cited by examiner

201

210 — Provide a nucleic acid (NA) sample comprising a plurality of NA molecules

220 — Ligate a heterologous adapter to a NA molecule of the plurality of NA molecules 230 — Subject the plurality of NA molecules to a thermal treatment, wherein the thermal treatment is sufficient to selectively circularize a NA molecules of the plurality of NA molecules that is smaller than a size threshold, such that an additional NA molecule of the plurality of NA molecules that is bigger than the size threshold remains linear 240 — Subject both (i) the circularized NA molecule and (ii) the linear additional NA molecule to sequencing (e.g., to different sequencing modalities)

*FIG. 2*

METHODS FOR PROCESSING A NUCLEIC ACID SAMPLE AND COMPOSITIONS THEREOF

CROSS-REFERENCE

The present application is a continuation of International Application No. PCT/US22/44943, filed Sep. 27, 2022, which claims the benefit of U.S. Provisional Application No. 63/249,177, filed Sep. 28, 2021, each of which is entirely incorporated herein by reference.

SEQUENCE LISTING

The instant application contains a Sequence Listing which has been submitted electronically in XML file format and is hereby incorporated by reference in its entirety. Said XML copy, created on Jun. 12, 2024, is named 52486_704_301_SL.xml, and is 148,883 bytes in size.

BACKGROUND

Nucleic acid sequencing may be used to provide sequence information for a nucleic acid sample. Such sequence information may be helpful in diagnosing or treating a subject (e.g., an individual, a patient, etc.) of a condition (e.g., a disease). For example, nucleic acid sequence information of a subject may be used to identify, diagnose, or develop a treatment for one or more genetic diseases. In another example, nucleic acid sequence information of one or more pathogens may lead to treatment for one or more contagious diseases.

Detection of one or more rare sequence variants (e.g., mutations) may be valuable for healthcare. Detection of rare sequence variants may be important for and early detection of one or more pathological mutations. Detection of one or more cancer-associated mutations (e.g., point mutations) in clinical samples may improve identification of one or more minimal residual diseases during chemotherapy or detection of tumor cells in relapsing patients. Additionally, such detection of the mutation(s) may be important for assessment of exposure to environmental mutagens, monitoring endogenous DNA repair, or studying accumulation of one or more somatic mutations in aging individuals. The detection or rare sequence variant(s) may enhance prenatal diagnosis and enable characterization of fetal cells present in maternal blood.

SUMMARY

The present disclosure provides methods and systems for processing a sample (e.g., a nucleic acid sample derived from a biological sample). Some aspects of the present disclosure provide methods of preparing a nucleic acid sample for sequencing, e.g., simultaneously preparing at least two different populations of nucleic acid molecules that are usable as templates for at least two different sequencing modalities. In some embodiments, the at least two different sequencing modalities may comprise short-read sequencing and long-read sequencing. Some aspects of the present disclosure provide method of sequencing the at least two different populations of nucleic acid molecules. Some aspects of the present disclosure provide nucleic acid compositions prepared by any one of the methods disclosed herein. Some aspects of the present disclosure provide systems for performing any one of the methods disclosed herein.

In an aspect, the present disclosure provides a method of library construction for generating, simultaneously, (i) linear deoxyribonucleic acid (DNA) templates for long sequencing reads and (ii) circular DNA templates for high accuracy consensus sequencing, the method comprising: (a) shearing a sample comprising a DNA molecule to generate an additional sample comprising a plurality of DNA fragments, wherein a length of a DNA fragment in the plurality of DNA fragments is between about 0.3 kilobases (kb) and about 50 kb; (b) repairing (1) one or more ends and/or (2) one or more internal nicks of the DNA fragment; (c) performing A-tailing of blunt ends of the DNA fragment; (d) ligating an adapter to each end of the DNA fragment, wherein the adapter comprises one or more Uracils in specific locations; (e) digesting the one or more Uracils with an enzyme to, such that the DNA fragment comprises complementary cohesive ends; (f) subsequent to (e), diluting the additional sample, and subjecting the diluted additional sample to heat for about 5 minutes at a temperature between about 70° C. and about 75° C.; (g) performing time-controlled cooling that is sufficient to effect (1) predominant circularization of a short DNA fragment of the plurality of DNA fragments, wherein the short DNA fragments has a size that is smaller than a size threshold, while (2) disfavoring circularization of a long DNA fragment of the plurality of DNA fragments, wherein the long DNA fragment has a size that is greater than the size threshold; and (h) performing ligation reaction to seal a nick in the circularized short DNA fragment, to generate a double-stranded circular sequencing template comprising a gap in a strand, wherein a 3' end of the gap serves as a priming site for polymerase synthesis. In some embodiments of any one of the methods disclosed herein, the size threshold is about 3 kilobases (kb). In some embodiments of any one of the methods disclosed herein, the size threshold is about 2 kb. In some embodiments of any one of the methods disclosed herein, the size threshold is about 1 kb.

In some embodiments of any one of the methods disclosed herein, sequencing of the double-stranded circular sequencing template is initiated from the gap.

In some embodiments of any one of the methods disclosed herein, sequencing of the long DNA fragment that is not circularized is initiated by annealing of a primer to the long DNA fragment.

In some embodiments of any one of the methods disclosed herein, the enzyme is a fusion enzyme comprising (i) at least a portion of an enzyme and (ii) at least a portion of an additional enzyme.

In another aspect, the present disclosure provides a method for processing a nucleic acid (NA) sample, comprising: (a) providing the NA sample comprising a first plurality of NA molecules; (b) ligating an adapter to a NA molecule of the first plurality of NA molecules, to yield a second plurality of NA molecules; and (c) subsequent to (b), subjecting the second plurality of NA molecules to a thermal treatment, wherein the thermal treatment is sufficient to selectively circularize a NA molecule of the second plurality of NA molecules that is smaller than a size threshold, to yield a mixture comprising the NA molecule that is circularized and an additional NA molecule of the second plurality of NA molecules that (i) is greater than or equal to the size threshold and (ii) is uncircularized, wherein both the NA molecule that is circularized and the additional NA molecule that is uncircularized are usable for sequencing.

In some embodiments of any one of the methods disclosed herein, the size threshold is about 3 kilobases (kb). In some embodiments of any one of the methods disclosed herein, the size threshold is about 2 kb. In some embodiments of any one of the methods disclosed herein, the size threshold is about 1 kb.

In some embodiments of any one of the methods disclosed herein, the thermal treatment is sufficient to selectively circularize a subpopulation of NA molecules of the second plurality of NA molecules, wherein the subpopulation of NA molecules has an average size that is smaller than the size threshold, to yield the mixture comprising the subpopulation of NA molecules that are each circularized and an additional subpopulation of NA molecules that (i) have an average size that is greater than or equal to the size threshold and (ii) are each uncircularized.

In some embodiments of any one of the methods disclosed herein, the method further comprises, subsequent to (c), subjecting both of (i) the circularized NA molecule and (ii) the uncircularized additional NA molecule to sequencing.

In some embodiments of any one of the methods disclosed herein, sequencing of the circularized NA molecule comprises sequencing-by-synthesis. In some embodiments, the circularized NA molecule comprises a heterologous gap for initiation of the sequencing-by-synthesis. In some embodiments, the sequencing does not comprise annealing a primer to the circularized NA molecule. In some embodiments of any one of the methods disclosed herein, sequencing of the uncircularized additional NA molecule comprises annealing of a primer to the uncircularized additional NA molecule.

In some embodiments of any one of the methods disclosed herein, in (c), the method further comprises subjecting the circularized NA molecule to a ligation reaction.

In some embodiments of any one of the methods disclosed herein, the thermal treatment comprises subjecting the second plurality of NA molecules to heating at temperature between about 60° C. and about 85° C. In some embodiments of any one of the methods disclosed herein, the thermal treatment comprises subjecting the second plurality of NA molecules to heating at temperature between about 70° C. and about 75° C. In some embodiments of any one of the methods disclosed herein, the thermal treatment comprises subjecting the second plurality of NA molecules to heating for less than or equal to about 10 minutes. In some embodiments of any one of the methods disclosed herein, the thermal treatment comprises subjecting the second plurality of NA molecules to heating for less than or equal to about 5 minutes. In some embodiments of any one of the methods disclosed herein, the thermal treatment comprises subjecting the second plurality of NA molecules to cooling at a rate of between about 0.1° C./min and about 100° C./min.

In some embodiments of any one of the methods disclosed herein, a concentration of the first plurality of NA molecules is about 0.01 nM to about 10 nM.

In some embodiments of any one of the methods disclosed herein, the adapter is a heterologous adapter.

In some embodiments of any one of the methods disclosed herein, (i) the circularized NA molecule comprises the adapter or a derivative thereof and (ii) the linear additional NA molecule comprises the adapter or a derivative thereof.

In some embodiments of any one of the methods disclosed herein, the adapter comprises one or more uracils. In some embodiments of any one of the methods disclosed herein, the adapter comprises a first adapter and a second adapter, and wherein the method further comprises, in (b), (1) ligating the first adapter to a first end of the NA molecule and (2) ligating the second adapter to a second end of the NA molecule. In some embodiments of any one of the methods disclosed herein, the first adapter comprises one or more uracils. In some embodiments of any one of the methods disclosed herein, the second adapter comprises one or more uracils. In some embodiments of any one of the methods disclosed herein, the method further comprises, subsequent to the ligating, digesting the one or more uracils in the first adapter and the second adapter, such that the NA molecule comprises complementary cohesive ends.

In some embodiments of any one of the methods disclosed herein, the method further comprises, prior to (b), subjecting the NA molecule to polyadenylation.

In some embodiments of any one of the methods disclosed herein, the method further comprises, prior to (b), repairing (1) one or more ends and/or (2) one or more internal nicks of the NA molecule.

In some embodiments of any one of the methods disclosed herein, the first plurality of NA molecules has an average size of between about 0.1 kb and about 200 kb. In some embodiments of any one of the methods disclosed herein, the first plurality of NA molecules has an average size of between about 0.2 kb and about 50 kb.

In some embodiments of any one of the methods disclosed herein, the method further comprises, in (a), subjecting an initial nucleic acid sample to NA fragmentation, to generate the nucleic acid sample. In some embodiments of any one of the methods disclosed herein, the NA fragmentation comprises NA shearing.

In some embodiments of any one of the methods disclosed herein, the second plurality of NA molecules comprises a plurality of double-stranded NA molecules. In some embodiments of any one of the methods disclosed herein, the second plurality of NA molecules comprises a plurality of deoxyribonucleic acid (DNA) molecules.

In another aspect, the present disclosure provides a composition comprising a mixture comprising a plurality of nucleic acid (NA) molecules, wherein the plurality of NA molecules comprises: a NA molecule that is smaller than a size threshold, wherein the first NA molecule is circularized via an adapter; and an additional NA molecule that is greater than or equal to the size threshold, wherein the additional NA molecule is uncircularized and comprises an additional heterologous adapter, wherein the heterologous adapter and the additional heterologous adapter are substantially the same, wherein both of the NA molecule that is circularized and the additional NA molecule that is uncircularized are usable for sequencing.

In some embodiments of any one of the compositions disclosed herein, both of the NA molecule and the additional NA molecule are derived from a same initial NA sample.

In some embodiments of any one of the compositions disclosed herein, the additional NA molecule comprises (1) the additional adapter at a first end of the additional NA molecule and (2) a different adapter at a second end of the additional NA molecule. In some embodiments of any one of the compositions disclosed herein, the additional adapter and the different adapter are the same.

In some embodiments of any one of the compositions disclosed herein, the size threshold is about 3 kilobases (kb). In some embodiments of any one of the methods disclosed herein, the size threshold is about 2 kb. In some embodiments of any one of the compositions disclosed herein, the size threshold is about 1 kb.

In some embodiments of any one of the compositions disclosed herein, the plurality of NA molecules comprises (i) a plurality of circularized NA molecules having an average size that is smaller than the size threshold, wherein each of the plurality of circularized NA molecules is circularized via the adapter or a derivative thereof, and (ii) a plurality of uncircularized NA molecules having an average size that is greater than or equal to the size threshold, wherein each of the plurality of uncircularized NA molecules comprises the additional adapter or a derivative thereof. In some embodiments of any one of the compositions disclosed herein, an amount of the plurality of circularized NA molecules is at least about 5% of the plurality of NA molecules. In some embodiments of any one of the compositions disclosed herein, an amount of the plurality of uncircularized NA molecules is at least about 5% of the plurality of NA molecules.

In some embodiments of any one of the compositions disclosed herein, the NA molecule is adapted for sequencing-by-synthesis. In some embodiments of any one of the compositions disclosed herein, the NA molecule comprises a heterologous gap for initiation of the sequencing-by-synthesis. In some embodiments of any one of the compositions disclosed herein, the sequencing-by-synthesis does not comprise annealing a primer to the circularized NA molecule.

In some embodiments of any one of the compositions disclosed herein, the additional NA molecule is adapted for sequencing via annealing of a primer to the additional NA molecule.

In some embodiments of any one of the compositions disclosed herein, the plurality of NA molecules has an average size of between about 0.1 kb and about 200 kb. In some embodiments of any one of the compositions disclosed herein, the plurality of NA molecules has an average size of between about 0.3 kb and about 50 kb.

In some embodiments of any one of the compositions disclosed herein, the plurality of NA molecules comprises a plurality of double-stranded NA molecules. In some embodiments of any one of the compositions disclosed herein, the plurality of NA molecules comprises a plurality of deoxyribonucleic acid (DNA) molecules.

In some embodiments of any one of the compositions disclosed herein, the adapter is a heterologous adapter.

Additional aspects and advantages of the present disclosure will become readily apparent to those skilled in this art from the following detailed description, wherein only illustrative embodiments of the present disclosure are shown and described. As will be realized, the present disclosure is capable of other and different embodiments, and its several details are capable of modifications in various obvious respects, all without departing from the disclosure. Accordingly, the drawings and description are to be regarded as illustrative in nature, and not as restrictive.

INCORPORATION BY REFERENCE

All publications, patents, and patent applications mentioned in this specification are herein incorporated by reference to the same extent as if each individual publication, patent, or patent application was specifically and individually indicated to be incorporated by reference. To the extent publications and patents or patent applications incorporated by reference contradict the disclosure contained in the specification, the specification is intended to supersede and/or take precedence over any such contradictory material.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings (also "Figure" and "FIG." herein), of which:

FIG. 2 schematically illustrates another example of a method for processing a nucleic acid sample.

FIG. 4A illustrates a model system for producing double-stranded DNA and circularizing the dsDNA to generate circular and linear dsDNA; FIG. 4B illustrates the nucleotide level scheme of circularization mechanism; FIG. 4B discloses SEQ ID NOS. 1-10, respectively, in order of appearance; FIG. 4C illustrates the PAA gel electrophoresis result of circularization of 0.2 kb dsDNA and 1 kb dsDNA under Fast Cooling protocol and Slow Cooling protocol; FIG. 4D illustrates the agarose gel electrophoresis result of circularization of 5 kb dsDNA under Fast Cooling protocol and Slow Cooling protocol, and with different dsDNA concentration; FIG. 4E shows the efficiency of circularization for 0.2 kb, 1 kb, and 5 kb dsDNA, under Fast Cooling protocol and Slow Cooling protocol; FIG. 4F shows the efficiency of circularization for 5 kb dsDNA under Fast Cooling protocol and Slow Cooling protocol, and with different dsDNA concentration.

DETAILED DESCRIPTION

Figure 1A:
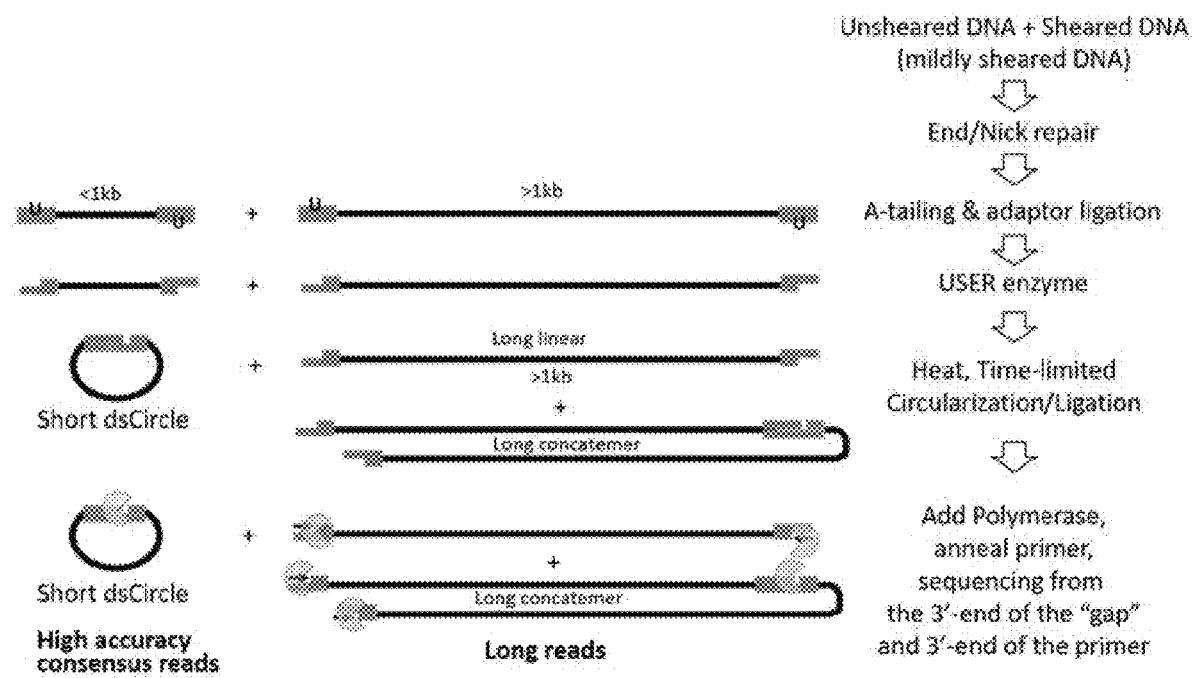
FIG. 1A schematically illustrates an example of a method for processing a nucleic acid sample.

While various embodiments of the invention have been shown and described herein, it will be obvious to those skilled in the art that such embodiments are provided by way of example only. Numerous variations, changes, and substitutions may occur to those skilled in the art without departing from the invention. It should be understood that various alternatives to the embodiments of the invention described herein may be employed.

As used in the specification and claims, the singular forms "a," "an," and "the" can include plural references unless the context clearly dictates otherwise. For example, the term "a transmembrane receptor" can include a plurality of transmembrane receptors.

The term "about" or "approximately," as used herein, can refer to within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, preferably within 5-fold, and more preferably within 2-fold, of a value. Where particular values are described in the application and claims, unless otherwise stated, the term "about" meaning within an acceptable error range for the particular value should be assumed.

The term "circularize" or "circularization," as used herein, generally refers to the structure of a polynucleotide molecule with both of its ends coupled to each other (e.g., via covalent and/or hydrogen bonds). The ends of the polynucleotide molecule may be directly coupled to each other. Alternatively, the ends of the polynucleotide molecule may be indirectly coupled to each other via a coupling moiety, e.g., a separate molecule capable of binding to each of the two ends of the polynucleotide molecule.

The term "selective circularization" or "selectively circularize," as used herein, generally refers to circularization of more polynucleotides of a first population of polynucleotides as compared to those of another population of nucleotides, e.g., at a greater rate of circularization in the first population of polynucleotides than that in the second population of polynucleotides, by at least about 1%, at least about 2%, at least about 5%, at least about 10%, at least about 15%, at least about 20%, at least about 25%, at least about 30%, at least about 40%, at least about 50%, at least about 60%, at least about 70%, at least about 80%, at least about 90%, at least about 95%, at least about 99%, or more. In some cases, an average polynucleotide length of the first population of polynucleotides can be less than that of the second population of polynucleotides by at least about 1%, at least about 2%, at least about 5%, at least about 10%, at least about 15%, at least about 20%, at least about 25%, at least about 30%, at least about 40%, at least about 50%, at least about 60%, at least about 70%, at least about 80%, at least about 90%, at least about 95%, or more.

Alternatively or in addition to, the term "selective circularization" or "selectively circularize" as used herein, generally refers to circularization of at least a portion of a population of polynucleotides (e.g., upon treating the population of polynucleotides under substantially the same conditions). The at least the portion of the population of polynucleotides that is circularized can be at least about 50%, at least about 52%, at least about 54%, at least about 55%, at least about 56%, at least about 58%, at least about 60%, at least about 62%, at least about 64%, at least about 65%, at least about 66%, at least about 68%, at least about 70%, at least about 75%, at least about 80%, at least about 85%, at least about 90%, at least about 95%, at least about 99%, or substantially about 100%. The at least the portion of the population of polynucleotides that is circularized can be at most about 100%, at most about 99%, at most about 95%, at most about 90%, at most about 85%, at most about 80%, at most about 75%, at most about 70%, at most about 68%, at most about 66%, at most about 65%, at most about 64%, at most about 62%, at most about 60%, at most about 58%, at most about 56%, at most about 55%, at most about 54%, at most about 52%, or at most about 50%.

The term "circularization efficiency" or "efficiency of circularization," as used interchangeably herein, generally refers to the percentage of polynucleotides that are circularized in a sample. Fore example, a circularization efficiency of 50% refers to 50% of the polynucleotides in the sample are circularized while the other 50% of the polynucleotides in the sample are uncircularized (e.g., linear).

The terms "polynucleotide," "oligonucleotide," "oligomer," and "nucleic acid," as used interchangeably herein, generally refer to a polymeric form of nucleotides of any length, either deoxyribonucleotides or ribonucleotides, or analogs thereof, either in single-, double-, or multi-stranded form. A polynucleotide can be exogenous or endogenous to a cell. A polynucleotide can exist in a cell-free environment. A polynucleotide can be a gene or fragment thereof. A polynucleotide can be DNA. A polynucleotide can be RNA.

A polynucleotide can have any three dimensional structure, and can perform any function. A polynucleotide can comprise one or more analogs (e.g. altered backbone, sugar, or nucleobase). If present, modifications to the nucleotide structure can be imparted before or after assembly of the polymer. Some non-limiting examples of analogs include: 5-bromouracil, peptide nucleic acid, xeno nucleic acid, morpholinos, locked nucleic acids, glycol nucleic acids, threose nucleic acids, dideoxynucleotides, cordycepin, 7-deaza-GTP, fluorophores (e.g. rhodamine or fluorescein linked to the sugar), thiol containing nucleotides, biotin linked nucleotides, fluorescent base analogs, CpG islands, methyl-7-guanosine, methylated nucleotides, inosine, thiouridine, pseudouridine, dihydrouridine, queuosine, and wyosine. Non-limiting examples of polynucleotides include coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, complementary DNA (cDNA, such as double-strand cDNA (ddcDNA) or single-stranded cDNA (ss-cDNA)), circulating tumor DNA (ctDNA), damaged DNA, recombinant polynucleotides, branched polynucleotides, plasmids, vectors, isolated DNA of any sequence, isolated RNA of any sequence, cell-free polynucleotides including cell-free DNA (cfDNA) and cell-free RNA (cfRNA), nucleic acid probes (e.g., fluorescence in situ hybridization (FISH) probes), and primers. The sequence of nucleotides can be interrupted by non-nucleotide components. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide can be further modified after polymerization, such as by conjugation with a labeling component.

The terms "complement," "complements," "complementary," and "complementarity," as used interchangeably herein, generally refer to a sequence that is fully complementary to and hybridizable to the given sequence. A sequence hybridized with a given nucleic acid is referred to as the "complement" or "reverse-complement" of the given molecule if its sequence of bases over a given region is capable of complementarily binding those of its binding partner, such that, for example, A-T, A-U, G-C, and G-U base pairs are formed. In general, a first sequence that is hybridizable to a second sequence is specifically or selectively hybridizable to the second sequence, such that hybridization to the second sequence or set of second sequences is preferred (e.g. thermodynamically more stable under a given set of conditions, such as stringent conditions commonly used in the art) to hybridization with non-target sequences during a hybridization reaction. Typically, hybridizable sequences share a degree of sequence complementarity over all or a portion of their respective lengths, such as between 25%-100% complementarity, including at least 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, and 100% sequence complementarity. The respective lengths may comprise a region of at least 2, 3, 4, 5, 6, 7, 8, 9, 10, 11, 12, 13, 14, 15, 16, 17, 18, 19, 20, 21, 22, 23, 24, 25, 30, 35, 40, 45, 50, or more nucleotides. Sequence identity, such as for the purpose of assessing percent complementarity, can be measured by any suitable alignment algorithm, including but not limited to the Needleman-Wunsch algorithm, the BLAST algorithm, or the Smith- Waterman algorithm. Optimal alignment can be assessed using any suitable parameters of a chosen algorithm, including default parameters.

Complementarity can be perfect or substantial/sufficient. Perfect complementarity between two nucleic acids can mean that the two nucleic acids can form a duplex in which every base in the duplex is bonded to a complementary base by Watson-Crick pairing. Substantial or sufficient complementary can mean that a sequence in one strand is not completely and/or perfectly complementary to a sequence in an opposing strand, but that sufficient bonding occurs between bases on the two strands to form a stable hybrid complex in set of hybridization conditions (e.g., salt concentration and temperature). Such conditions can be predicted by using the sequences and standard mathematical calculations to predict the Tm of hybridized strands, or by empirical determination of Tm by using routine methods.

The term "hybridization" as used herein, generally refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner according to base complementarity. The complex may comprise two strands forming a duplex structure, three or more strands forming a multi-stranded complex, a single self-hybridizing strand, or any combination of these. A hybridization reaction may constitute a step in a more extensive process, such as the initiation of PCR, or the enzymatic cleavage of a polynucleotide by an endonuclease. A second sequence that is complementary to a first sequence may be referred to as the "complement" of the first sequence. The term "hybridizable," as applied to a polynucleotide, generally refers to the ability of the polynucleotide to form a complex that is stabilized via hydrogen bonding between the bases of the nucleotide residues in a hybridization reaction.

The term "polymerase," as used herein, generally refers to an enzyme (e.g., natural or synthetic) capable of catalyzing a polymerization reaction. Examples of polymerases can include a nucleic acid polymerase (e.g., a DNA polymerase or an RNA polymerase), a transcriptase, and a liage. A polymerase can be a polymerization enzyme. The term "DNA polymerase" generally refers to an enzyme capable of catalyzing a polymerization reaction of DNA.

The term "sequencing," as used herein, generally refers to a procedure for determining the order in which nucleotides occur in a target nucleotide sequence. Methods of sequencing can comprise high-throughput sequencing, such as, for example, next-generation sequencing (NGS). Sequencing may be whole-genome sequencing or targeted sequencing. Sequencing may be single molecule sequencing or massively parallel sequencing. Next-generation sequencing methods can be useful in obtaining millions of sequences in a single run. In an example, sequencing may be performed using one or more nanopore sequencing methods, e.g., sequencing-by-synthesis, sequencing-by-ligation, or sequencing-by-cleavage.

The term "nanopore," as used herein, generally refers to a pore, channel, or passage formed or otherwise provided in a membrane. The membrane may be an organic membrane, such as a lipid bilayer, or a synthetic membrane, such as a membrane formed of a polymeric material such as a protein nanopore. The membrane may be a solid state membrane (e.g., silicon substrate). The nanopore may be disposed adjacent or in proximity to a sensing circuit or an electrode coupled to a sensing circuit, such as, for example, a complementary metal-oxide semiconductor (CMOS) or field effect transistor (FET) circuit. The nanopore may be part of the sensing circuit. A nanopore can have a characteristic width or diameter, for example, on the order of about 0.1 nanometer (nm) to 1000 nm. A nanopore can be a biological nanopore, solid state nanopore, hybrid biological-solid state nanopore, a variation thereof, or a combination thereof. Examples of the biological nanopore include, but are not limited to, OmpG from E. coli, sp., Salmonella sp., Shigella sp., and Pseudomonas sp., and alpha hemolysin (α-hemolysin) from S. aureus sp., MspA from M. smegmatis sp, a functional variant thereof, or a combination thereof. Sequencing may comprise forward sequencing and/or reverse sequencing. Examples of the solid state nanopore include, but are not limited to, silicon nitride, silicon oxide, graphene, molybdenum sulfide, a functional variant thereof, or a combination thereof. The solid state nanopore may be fabricated by high-energy beam manufacturing, imprinting (e.g., nanoimprinting), laser ablation, chemical etching, plasma etching (e.g., oxygen plasma etching), etc.

The terms "nanopore sequencing" and "nanopore-based sequencing," as used interchangeably herein, generally refer to a method that determines the sequence of a polynucleotide with the aid of a nanopore. In some cases, the sequence of the polynucleotide may be determined in a template-dependent manner. In some cases, the methods, systems, or compositions disclosed herein may not be limited to any particular nanopore sequencing method, system, or device.

The term "sample," as used herein, generally refers to any sample that may include one or more constituents (e.g., nucleic acid molecules) for processing or analysis. The sample may be a biological sample. The sample may be a cellular or tissue sample. The sample may be a cell-free sample, such as blood (e.g., whole blood), plasma, serum, sweat, saliva, or urine. The sample may be obtained in vivo or cultured in vitro.

The term "subject," as used herein, generally refers to an individual or entity from which a sample is derived, such as, for example, a vertebrate (e.g., a mammal, such as a human) or an invertebrate. A mammal may be a murine, simian, human, farm animal (e.g., cow, goat, pig, or chicken), or a pet (e.g., cat or dog). The subject may be a plant. The subject may be a patient. The subject may be asymptomatic with respect to a disease (e.g., cancer). Alternatively, the subject may be symptomatic with respect to the disease.

I. Processing a Nucleic Acid Sample

In an aspect, the present disclosure provides a method for processing a nucleic acid (NA) sample comprising a first plurality of NA molecules. The first plurality of NA molecules may be a plurality of linear NA molecules. The method may comprise forming a complex comprising at least one adapter (e.g., a single adapter or two adapters that are the same or different) and a NA molecule of the first plurality of NA molecules, to yield a second plurality of NA molecules. In some examples, the method may comprise ligating (e.g., chemically or enzymatically conjugating) the at least one adapter to the NA molecule. The method may further comprise (e.g., subsequent to the formation of the complex), subjecting the second plurality of NA molecules to a thermal treatment (e.g., heating and/or cooling, such as heating and cooling in a sequential manner), and the thermal treatment may be sufficient to (or may be preconfigured to) yield selective circularization of one or more NA molecules that are smaller than a size threshold from the second plurality of NA molecules, while one or more NA molecules (e.g., the other molecules) that are bigger than or equal to the size threshold from the second plurality of NA molecules are substantially not circularized (e.g., remain as linear NA molecule(s)). Alternatively or in addition to, of the one or more NA molecules that are each bigger than or equal to the size threshold may form a complex (e.g., a concatemer) with each other, thus forming at least one supra-NA molecule that is still bigger than or equal to the size threshold.

Thus, in some examples, any of the methods disclosed herein may simultaneously generate a sequencing library comprising at least two groups of NA samples for sequencing: (i) a first group comprising a circularized NA molecule that is smaller than the size threshold and (ii) a second group comprising a uncircularized (or non-circularized) NA molecule that is bigger than or equal to the size threshold.

Without wishing to be found by theory, the longer the NA molecule is (e.g., comprising the one or more adapters as disclosed herein), the longer the time and/or energy it can take for two ends of the NA molecule (e.g., two adapters coupled to the opposite ends of the NA molecule) to find each other via random motion (e.g., via Brownian motion), while the NA molecule is suspended in a medium (e.g., an aqueous medium). Thus, one or more conditions of the thermal treatment (e.g., energy provided to the NA molecule or its medium via the thermal treatment, a duration of the thermal treatment, concentrations of the second plurality of molecules, size distribution of the second plurality of molecules, etc.) may provide the time and/or energy threshold that is sufficient (or just about enough) for one or more NA molecules that are smaller than the size threshold to circularize, via meeting of the two ends of each of the one or more NA molecules.

Each of the one or more NA molecules that are circularized may each be smaller than the size threshold. Each of the one or more NA molecules that are circularized may be derived from a single NA molecule of the first plurality of NA molecules. Thus, each of the one or more NA molecules that are circularized may not comprise more than one NA molecule of the first plurality of NA molecules.

The size threshold may be about 0.1 kilobase (kb) to about 100 kb. The size threshold may be at least about 0.1 kb. The size threshold may be at most about 100 kb. The size threshold may be about 0.1 kb to about 0.2 kb, about 0.1 kb to about 0.5 kb, about 0.1 kb to about 1 kb, about 0.1 kb to about 2 kb, about 0.1 kb to about 3 kb, about 0.1 kb to about 4 kb, about 0.1 kb to about 5 kb, about 0.1 kb to about 10 kb, about 0.1 kb to about 20 kb, about 0.1 kb to about 50 kb, about 0.1 kb to about 100 kb, about 0.2 kb to about 0.5 kb, about 0.2 kb to about 1 kb, about 0.2 kb to about 2 kb, about 0.2 kb to about 3 kb, about 0.2 kb to about 4 kb, about 0.2 kb to about 5 kb, about 0.2 kb to about 10 kb, about 0.2 kb to about 20 kb, about 0.2 kb to about 50 kb, about 0.2 kb to about 100 kb, about 0.5 kb to about 1 kb, about 0.5 kb to about 2 kb, about 0.5 kb to about 3 kb, about 0.5 kb to about 4 kb, about 0.5 kb to about 5 kb, about 0.5 kb to about 10 kb, about 0.5 kb to about 20 kb, about 0.5 kb to about 50 kb, about 0.5 kb to about 100 kb, about 1 kb to about 2 kb, about 1 kb to about 3 kb, about 1 kb to about 4 kb, about 1 kb to about 5 kb, about 1 kb to about 10 kb, about 1 kb to about 20 kb, about 1 kb to about 50 kb, about 1 kb to about 100 kb, about 2 kb to about 3 kb, about 2 kb to about 4 kb, about 2 kb to about 5 kb, about 2 kb to about 10 kb, about 2 kb to about 20 kb, about 2 kb to about 50 kb, about 2 kb to about 100 kb, about 3 kb to about 4 kb, about 3 kb to about 5 kb, about 3 kb to about 10 kb, about 3 kb to about 20 kb, about 3 kb to about 50 kb, about 3 kb to about 100 kb, about 4 kb to about 5 kb, about 4 kb to about 10 kb, about 4 kb to about 20 kb, about 4 kb to about 50 kb, about 4 kb to about 100 kb, about 5 kb to about 10 kb, about 5 kb to about 20 kb, about 5 kb to about 50 kb, about 5 kb to about 100 kb, about 10 kb to about 20 kb, about 10 kb to about 50 kb, about 10 kb to about 100 kb, about 20 kb to about 50 kb, about 20 kb to about 100 kb, or about 50 kb to about 100 kb. The size threshold may be about 0.1 kb, about 0.2 kb, about 0.5 kb, about 1 kb, about 2 kb, about 3 kb, about 4 kb, about 5 kb, about 10 kb, about 20 kb, about 50 kb, or about 100 kb. The size threshold may be a predetermined size threshold, e.g., based on the selected thermal treatment (e.g., selected temperature and/or time).

In some cases, the size threshold may be an average size of nucleic acid molecules which have a circularization efficiency of more than about 55%, more than about 60%, more than about 65%, more than about 70%, more than about 75%, more than about 80%, or more. In some cases, the size threshold is about 3 kilobases (kb). In some cases, the size threshold is about 2 kb. In some cases, the size threshold is about 1 kb.

In some cases, at least about 30%, at least about 40%, at least about 50%, at least about 60%, at least about 70%, at least about 80%, at least about 85%, at least about 90%, at least about 95%, at least about 99%, or substantially all of (or each of) the first plurality of NA molecules of the NA sample may be ligated with an adapter of the at least one adapter. In some cases, a NA molecule may be ligated with a single adapter at one end of the NA molecule. In some examples, the single adapter (or a derivative thereof) may effect circularization of the NA molecule, given one or more sufficient conditions disclosed herein (e.g., size of the NA molecule, heating and/or cooling cycle(s), etc.). In some cases, a NA molecule may be ligated with a first adapter at a first end of the NA molecule, and with a second adapter at a second end (or the other end) of the NA molecule. In some examples, the first adapter (or a derivative thereof) and the second adapter (or a derivative thereof) at the two ends of the NA molecule may effect circularization of the NA molecule, given the one or more sufficient condition disclosed herein.

Both of (i) the one or more NA molecules that are circularized and smaller than the size threshold and (ii) the one or more NA molecules that are not circularized and bigger than or equal to the size threshold may be usable for sequencing. In some cases, (i) the one or more NA molecules that are circularized may be usable for a first sequencing modality and (ii) the one or more NA molecules that are not circularized may be usable for a second and different sequencing modality. Accordingly, the method as disclosed herein may achieve a single process (e.g., comprising a single thermal treatment) that yields production of two different types of NA molecules, e.g., for two different sequencing modalities. The method as disclosed herein thus may eliminate the need for two or more separate preparation processes of the NA sample for multiple sequencing modalities, thereby reducing cost and time required for performing the multiple sequencing modalities. In some examples, (i) the one or more NA molecules that are circularized may be usable for short-read sequencing and (ii) the one or more NA molecules that are not circularized may be usable for long-read sequencing. Short-read sequencing may be cost-effective. However, natural nucleic acid polymers may span eight orders of magnitude in length, and thus sequencing them in short, amplified fragments (e.g., via short-read sequencing) may complicate the task of reconstructing and counting the original molecules. Thus, a parallel use of long-read sequencing, based on templates derived from the same original sample as the templates for short-read sequencing, may reduce amplification bias, and/or improve de novo assembly, mapping certainty, transcript isoform identification, and detection of structural variants.

Alternatively, (i) the one or more NA molecules that are circularized and smaller than the size threshold and (ii) the one or more NA molecules that are not circularized and bigger than or equal to the size threshold may be usable for a same sequencing modality.

A sequencing modality, as disclosed herein, can be a high-throughput sequencing method, such as next-generation sequencing (NGS) (e.g., sequencing by synthesis). A high-throughput sequencing method can sequence simultaneously (or substantially simultaneously) at least about 10,000, at least about 100,000, at least about 1 million, at least about 10 million, at least about 100 million, at least about 1 billion, or more polynucleotide molecules (e.g., cell-free nucleic acid molecules or derivatives thereof). NGS can be any generation number of sequencing technologies (e.g., second-generation sequencing technologies, third-generation sequencing technologies, fourth-generation sequencing technologies, etc.). Non-limiting examples of high-throughput sequencing methods include massively parallel signature sequencing, polony sequencing, pyrosequencing, sequencing-by-synthesis (SBS) (e.g., nanopore-based SBS), combinatorial probe anchor synthesis (cPAS), sequencing-by-ligation (e.g., sequencing by oligonucleotide ligation and detection (SOLID) sequencing), semiconductor sequencing (e.g., Ion Torrent semiconductor sequencing), DNA nanoball sequencing, and single-molecule sequencing, sequencing-by-hybridization.

In some cases, long-read sequencing data from uncircularized (e.g., linear) long nucleic acid template molecules (e.g., including heterologous concatemers) may be expected to have lower accuracy as compared to short-read sequencing data. The long-read sequencing data may be generated from one sequencing-by-syntheses pass of DNA polymerase and may have uncorrected errors. In contrast, each short-reads (e.g., from relatively "short" circularized templates) may be represented by multiple reads (e.g., multiple concatenated reads) of the same sequence, and, upon completion of sequencing, such multiple reads may be aligned in silico (e.g., by an analysis software) and be used for (i) identification of one or more errors and (ii) generation of highly accurate consensus sequence read. For example, given the processivity of strand-displacement polymerase Phi29 of about 70 kb, circular DNA templates having a size range between about 0.3 kb and about 1.0 kb may generate between about 10 and about 500 copy reads (e.g., between about 70 and about 233 copy reads). The higher the number of repeated reads, the higher the accuracy. This may be important, e.g., in detection of single nucleotide variants (SNV) and/or indels (e.g., insertion or deletion less than 50 bp). SNVs can include mutations and/or single nucleotide polymorphism (SNPs). However, despite the lower accuracy of the long sequencing reads (from relatively "long" linear molecules), the long sequencing reads may be important/indispensable in, e.g., assembly of long sequence contigs and, thus, increased accuracy in detecting and mapping of structural variations and performing de novo genome assembly (e.g., new microorganisms in metagenomics). Structural variations can be a large (e.g., greater than 50 kb) rearrangement of part of the genome, and can be a deletion, duplication, insertion, inversion, translocation, or a combination thereof. A copy number variation (CNV) can be a duplication or deletion that changes the number of copies of a particular DNA segment within the genome. Thus, the idea of generating the library in one seamless procedure (e.g., via both long-read sequencing and short-read sequencing as disclosed herein), which has simultaneously circular and linear fragments, where the short circular templates produce highly accurate consensus sequencing data, while less accurate in SNV mapping/detection the long reads from linear molecules enhance this data by providing the data for generation of long contigs and genome assembly scaffold while simultaneously taking care of structural variations.

In some cases, the short-read sequencing method can be circular consensus sequencing (CCS) method. In an example, the nucleic acid template for the short-read sequencing may be short (e.g., between about 0.2 kb and about 1-2 kb), and the resulting read itself may be longer (e.g., up to about 70 kb on average).

In some cases, the circularized NA molecule (e.g., a double-stranded DNA molecule that is smaller than the size threshold) generated by any of the methods disclosed herein may comprise a gap (e.g., a heterologous gap) at a specific site within the circularized NA molecule (e.g., a heterologous gap in one of the two strands of the circularized double-stranded NA molecule). In an example, the circularized NA molecule may comprise the heterologous gap within the heterologous adapter that induced the circularization. When the circularized NA molecule is subjected to SBS (e.g., nanopore-based SBS as disclosed herein), sequencing of the circularized NA molecule may be initiated upon binding of a protein (e.g., an enzyme) to the heterologous gap (e.g., binding of a polymerase to transcribe at least a portion of the circularized NA molecule without a need for primer annealing). Thus, sequencing of the circularized NA molecule may not require annealing a nucleic acid primer to the circularized NA molecule, e.g., to, to initiate the sequencing. The linear NA molecule (e.g., a double-stranded DNA molecule that is greater than or equal to the size threshold) provided by any of the methods disclosed herein may be subjected to a different sequencing modality than SBS, e.g., by annealing a nucleic acid primer onto the linear NA first.

The methods disclosed herein may enhance sequencing accuracy (e.g., base calling accuracy) by at least about 0.1%, 0.2%, 0.5%, 1%, 2%, 3%, 4%, 5%, 6%, 7%, 8%, 9%, 10%, 15%, 20%, or more as compared to a control method. The methods disclosed herein may enhance sequencing sensitivity by at least about 0.1%, 0.2%, 0.5%, 1%, 2%, 3%, 4%, 5%, 6%, 7%, 8%, 9%, 10%, 15%, 20%, or more as compared to a control method. The methods disclosed herein may reduce background error rate d by at least about 0.1%, 0.2%, 0.5%, 1%, 2%, 3%, 4%, 5%, 6%, 7%, 8%, 9%, 10%, 15%, 20%, 30%, 40%, 50%, 60%, 70%, 80%, 90%, 95%, 99%, or more as compared to a control method. The methods disclosed herein may reduce sequencing error rate during sequencing by at least about 0.1%, 0.2%, 0.5%, 1%, 2%, 3%, 4%, 5%, 6%, 7%, 8%, 9%, 10%, 15%, 20%, 30%, 40%, 50%, 60%, 70%, 80%, 90%, 95%, 99%, or more as compared to a control method.

In an example, the control method as disclosed herein may comprise (i) subjecting a first NA sample to a first processing means to prepare a first NA template sample for a first type of sequencing modality (e.g., short-read sequencing), and (ii) subjecting a second/different NA sample to a second/different processing means to prepare a second/different NA template sample for a second/different type of sequencing modality (e.g., long-read sequencing). In another example, the control method as disclosed herein may comprise (i) subjecting a NA sample to a processing means to simultaneously prepare (i) a first NA template sample having a first average NA size and (ii) a second NA template sample having a second/different average NA size, and subjecting both of the first NA template sample and the second NA template sample to the same type of sequencing modality. In a different example, the control method as disclosed herein may be subjecting a NA sample to a processing means to prepare a NA template sample, and performing one single type of sequencing modality only (e.g., either short-read sequencing or long-read sequencing).

Upon the thermal treatment, a first subpopulation of the second plurality of NA molecules (e.g., each complexed with and flanked by two heterologous adapters that are the same), which first subpopulation having an average size that is smaller than the size threshold, may be transformed into a plurality of circularized NA molecules having an average size that is smaller than the size threshold. In addition, upon the thermal treatment, a second subpopulation of the second plurality of NA molecules (e.g., each complexed with and flanked by two heterologous adapters that are the same), which second subpopulation having an average size that is bigger than or equal to the size threshold, may not be circularized but rather remain as a plurality of linear NA molecules having an average size that is bigger than or equal to the size threshold.

Upon the thermal treatment, at least about 10%, 20%, 30%, 40%, 50%, 60%, 70%, 80%, 85%, 90%, 95%, 99%, or more of (e.g., substantially all of) the first subpopulation may be circularized. Upon the thermal treatment, at most about 100%, 95%, 90%, 85%, 80%, 70%, 60%, 50%, 40%, 30%, 20%, 10%, or less of the first subpopulation may be circularized. Upon the thermal treatment, at least about 10%, 20%, 30%, 40%, 50%, 60%, 70%, 80%, 85%, 90%, 95%, 99%, or more of (e.g., substantially all of) the second subpopulation may remain uncircularized (e.g., linear). Upon the thermal treatment, at most about 100%, 95%, 90%, 85%, 80%, 70%, 60%, 50%, 40%, 30%, 20%, 10%, or less of the second subpopulation may remain uncircularized (e.g., linear).

The first subpopulation may comprise at least about 2, 5, 10, 20, 50, 100, 200, 500, 1,000, 2,000, 5,000, 10,000, 20,000, 50,000, 100,000, 200,000, 500,000, 1,000,000, 2,000,000, 5,000,000, or more NA molecules. The first subpopulation may comprise at most about 5,000,000, 2,000,000, 1,000,000, 500,000, 200,000, 100,000, 50,000, 20,000, 10,000, 5,000, 2,000, 1,000, 500, 200, 100, 50, 20, 10, 5, or 2 NA molecules. The second subpopulation may comprise at least about 2, 5, 10, 20, 50, 100, 200, 500, 1,000, 2,000, 5,000, 10,000, 20,000, 50,000, 100,000, 200,000, 500,000, 1,000,000, 2,000,000, 5,000,000, or more NA molecules. The second subpopulation may comprise at most about 5,000,000, 2,000,000, 1,000,000, 500,000, 200,000, 100,000, 50,000, 20,000, 10,000, 5,000, 2,000, 1,000, 500, 200, 100, 50, 20, 10, 5, or 2 NA molecules.

The thermal treatment as disclosed herein may comprise at least one heating step. The at least one heating step may comprise at least about 1, 2, 3, 4, 5, 6, 7, 8, 9, 10, or more heating steps. The at least one heating step may comprise at most about 10, 9, 8, 7, 6, 5, 4, 3, 2, or 1 heating step. The at least one heating step may comprise subjecting the plurality of NA molecules to a desired heating temperature, e.g., immediately to the desired heating temperature. Alternatively, the at least one heating step may comprise subjecting the plurality of NA molecules to a temperature gradient, e.g., from an initial temperature to the desired heating temperature that is higher than the initial temperature.

The desired heating temperature of the thermal treatment may be about 50 degrees Celsius (° C.) to about 95° C. The desired heating temperature of the thermal treatment may be at least about 50° C. The desired heating temperature of the thermal treatment may be at most about 95° C. The desired heating temperature of the thermal treatment may be at least about 50° C., 55° C., 60° C., 65° C., 70° C., 75° C., 80° C., 85° C., 90° C., 95° C., or more. The desired heating temperature of the thermal treatment may be at most about 95° C., 90° C., 85° C., 80° C., 75° C., 70° C., 65° C., 60° C., 55° C., 50° C., or less. The desired heating temperature of the thermal treatment may be about 50° C. to about 60° C., about 50° C. to about 65° C., about 50° C. to about 67° C., about 50° C. to about 70° C., about 50° C. to about 72° C., about 50° C. to about 75° C., about 50° C. to about 77° C., about 50° C. to about 80° C., about 50° C. to about 85° C., about 50° C. to about 90° C., about 50° C. to about 95° C., about 60° C. to about 65° C., about 60° C. to about 67° C., about 60° C. to about 70° C., about 60° C. to about 72° C., about 60° C. to about 75° C., about 60° C. to about 77° C., about 60° C. to about 80° C., about 60° C. to about 85° C., about 60° C. to about 90° C., about 60° C. to about 95° C., about 65° C. to about 67° C., about 65° C. to about 70° C., about 65° C. to about 72° C., about 65° C. to about 75° C., about 65° C. to about 77° C., about 65° C. to about 80° C., about 65° C. to about 85° C., about 65° C. to about 90° C., about 65° C. to about 95° C., about 67° C. to about 70° C., about 67° C. to about 72° C., about 67° C. to about 75° C., about 67° C. to about 77° C., about 67° C. to about 80° C., about 67° C. to about 85° C., about 67° C. to about 90° C., about 67° C. to about 95° C., about 70° C. to about 72° C., about 70° C. to about 75° C., about 70° C. to about 77° C., about 70° C. to about 80° C., about 70° C. to about 85° C., about 70° C. to about 90° C., about 70° C. to about 95° C., about 72° C. to about 75° C., about 72° C. to about 77° C., about 72° C. to about 80° C., about 72° C. to about 85° C., about 72° C. to about 90° C., about 72° C. to about 95° C., about 75° C. to about 77° C., about 75° C. to about 80° C., about 75° C. to about 85° C., about 75° C. to about 90° C., about 75° C. to about 95° C., about 77° C. to about 80° C., about 77° C. to about 85° C., about 77° C. to about 90° C., about 77° C. to about 95° C., about 80° C. to about 85° C., about 80° C. to about 90° C., about 80° C. to about 95° C., about 85° C. to about 90° C., about 85° C. to about 95° C., or about 90° C. to about 95° C. The desired heating temperature of the thermal treatment may be about 50° C., about 60° C., about 65° C., about 67° C., about 70° C., about 72° C., about 75° C., about 77° C., about 80° C., about 85° C., about 90° C., or about 95° C.

The thermal treatment as disclosed herein may comprise at least one cooling step. The at least one cooling step may comprise at least about 1, 2, 3, 4, 5, 6, 7, 8, 9, 10, or more cooling steps. The at least one cooling step may comprise at most about 10, 9, 8, 7, 6, 5, 4, 3, 2, or 1 cooling step. The at least one cooling step may comprise subjecting the plurality of NA molecules to a desired cooling temperature, e.g., immediately to the desired cooling temperature. Alternatively, the at least one cooling step may comprise subjecting the plurality of NA molecules to a temperature gradient, e.g., from an initial temperature to a desired cooling that is lower than the initial temperature.

The desired cooling temperature of the thermal treatment may be lower than the desired heating temperature as disclosed herein by at least about 1° C., 2° C., 3° C., 4° C., 5° C., 6° C., 7° C., 8° C., 9° C., 10° C., 15° C., 20° C., 25° C., 30° C., 35° C., 40° C., 45° C., 50° C., 55° C., 60° C., 65° C., 70° C., 75° C., 80° C., 85° C., 90° C., or more. The desired cooling temperature of the thermal treatment may be lower than the desired heating temperature as disclosed herein by at most about 90° C., 85° C., 80° C., 75° C., 70°

C., 65° C., 60° C., 55° C., 50° C., 45° C., 40° C., 35° C., 30° C., 25° C., 20° C., 15° C., 10° C., 9° C., 8° C., 7° C., 6° C., 5° C., 4° C., 3° C., 2° C., 1° C., or less. The desired cooling temperature of the thermal treatment may be about 4° C. to about 60° C. The desired cooling temperature of the thermal treatment may be at least about 4° C. The desired cooling temperature of the thermal treatment may be at most about 60° C. The desired cooling temperature of the thermal treatment may be about 4° C. to about 10° C., about 4° C. to about 15° C., about 4° C. to about 20° C., about 4° C. to about 25° C., about 4° C. to about 30° C., about 4° C. to about 35° C., about 4° C. to about 40° C., about 4° C. to about 45° C., about 4° C. to about 50° C., about 4° C. to about 55° C., about 4° C. to about 60° C., about 10° C. to about 15° C., about 10° C. to about 20° C., about 10° C. to about 25° C., about 10° C. to about 30° C., about 10° C. to about 35° C., about 10° C. to about 40° C., about 10° C. to about 45° C., about 10° C. to about 50° C., about 10° C. to about 55° C., about 10° C. to about 60° C., about 15° C. to about 20° C., about 15° C. to about 25° C., about 15° C. to about 30° C., about 15° C. to about 35° C., about 15° C. to about 40° C., about 15° C. to about 45° C., about 15° C. to about 50° C., about 15° C. to about 55° C., about 15° C. to about 60° C., about 20° C. to about 25° C., about 20° C. to about 30° C., about 20° C. to about 35° C., about 20° C. to about 40° C., about 20° C. to about 45° C., about 20° C. to about 50° C., about 20° C. to about 55° C., about 20° C. to about 60° C., about 25° C. to about 30° C., about 25° C. to about 35° C., about 25° C. to about 40° C., about 25° C. to about 45° C., about 25° C. to about 50° C., about 25° C. to about 55° C., about 25° C. to about 60° C., about 30° C. to about 35° C., about 30° C. to about 40° C., about 30° C. to about 45° C., about 30° C. to about 50° C., about 30° C. to about 55° C., about 30° C. to about 60° C., about 35° C. to about 40° C., about 35° C. to about 45° C., about 35° C. to about 50° C., about 35° C. to about 55° C., about 35° C. to about 60° C., about 40° C. to about 45° C., about 40° C. to about 50° C., about 40° C. to about 55° C., about 40° C. to about 60° C., about 45° C. to about 50° C., about 45° C. to about 55° C., about 45° C. to about 60° C., about 50° C. to about 55° C., about 50° C. to about 60° C., or about 55° C. to about 60° C. The desired cooling temperature of the thermal treatment may be about 4° C., about 10° C., about 15° C., about 20° C., about 25° C., about 30° C., about 35° C., about 40° C., about 45° C., about 50° C., about 55° C., or about 60° C. For example, the desired cooling temperature may be room temperature, e.g., between about 20° C. and about 25° C.

The rate of change of temperature for the temperature gradient as disclosed herein (e.g., for increasing temperature or, alternatively, decreasing temperature) may be about 0.1 degree Celsius per minute (° C./min) to about 100° C./min. The rate of change of temperature for the temperature gradient may be at least about 0.1° C./min. The rate of change of temperature for the temperature gradient may be at most about 60° C./min. The rate of change of temperature for the temperature gradient may be about 0.1° C./min to about 0.5° C./min, about 0.1° C./min to about 1° C./min, about 0.1° C./min to about 2° C./min, about 0.1° C./min to about 5° C./min, about 0.1° C./min to about 10° C./min, about 0.1° C./min to about 15° C./min, about 0.1° C./min to about 20° C./min, about 0.1° C./min to about 30° C./min, about 0.1° C./min to about 40° C./min, about 0.1° C./min to about 50° C./min, about 0.1° C./min to about 60° C./min, about 0.1° C./min to about 80° C./min, about 0.1° C./min to about 100° C./min, about 0.5° C./min to about 1° C./min, about 0.5° C./min to about 2° C./min, about 0.5° C./min to about 5° C./min, about 0.5° C./min to about 10° C./min, about 0.5° C./min to about 15° C./min, about 0.5° C./min to about 20° C./min, about 0.5° C./min to about 30° C./min, about 0.5° C./min to about 40° C./min, about 0.5° C./min to about 50° C./min, about 0.5° C./min to about 60° C./min, about 0.5° C./min to about 80° C./min, about 0.5° C./min to about 100° C./min, about 0.8° C./min to about 1° C./min, about 0.8° C./min to about 2° C./min, about 0.8° C./min to about 5° C./min, about 0.8° C./min to about 10° C./min, about 0.8° C./min to about 15° C./min, about 0.8° C./min to about 20° C./min, about 0.8° C./min to about 30° C./min, about 0.8° C./min to about 40° C./min, about 0.8° C./min to about 50° C./min, about 0.8° C./min to about 60° C./min, about 0.8° C./min to about 80° C./min, about 0.8° C./min to about 100° C./min, about 1° C./min to about 2° C./min, about 1° C./min to about 5° C./min, about 1° C./min to about 10° C./min, about 1° C./min to about 15° C./min, about 1° C./min to about 20° C./min, about 1° C./min to about 30° C./min, about 1° C./min to about 40° C./min, about 1° C./min to about 50° C./min, about 1° C./min to about 60° C./min, about 1° C./min to about 80° C./min, about 1° C./min to about 100° C./min, about 2° C./min to about 5° C./min, about 2° C./min to about 10° C./min, about 2° C./min to about 15° C./min, about 2° C./min to about 20° C./min, about 2° C./min to about 30° C./min, about 2° C./min to about 40° C./min, about 2° C./min to about 50° C./min, about 2° C./min to about 60° C./min, about 2° C./min to about 80° C./min, about 2° C./min to about 100° C./min, about 5° C./min to about 10° C./min, about 5° C./min to about 15° C./min, about 5° C./min to about 20° C./min, about 5° C./min to about 30° C./min, about 5° C./min to about 40° C./min, about 5° C./min to about 50° C./min, about 5° C./min to about 60° C./min, about 5° C./min to about 80° C./min, about 5° C./min to about 100° C./min, about 10° C./min to about 15° C./min, about 10° C./min to about 20° C./min, about 10° C./min to about 30° C./min, about 10° C./min to about 40° C./min, about 10° C./min to about 50° C./min, about 10° C./min to about 60° C./min, about 10° C./min to about 80° C./min, about 10° C./min to about 100° C./min, about 15° C./min to about 20° C./min, about 15° C./min to about 30° C./min about 15° C./min to about 40° C./min, about 15° C./min to about 50° C./min, about 15° C./min to about 60° C./min, about 15° C./min to about 80° C./min, about 15° C./min to about 100° C./min, about 20° C./min to about 30° C./min, about 20° C./min to about 40° C./min, about 20° C./min to about 50° C./min, about 20° C./min to about 60° C./min, about 20° C./min to about 80° C./min, about 20° C./min to about 100° C./min, about 30° C./min to about 40° C./min, about 30° C./min to about 50° C./min, about 30° C./min to about 60° C./min, about 30° C./min to about 80° C./min, about 30° C./min to about 100° C./min, about 40° C./min to about 50° C./min, about 40° C./min to about 60° C./min, about 40° C./min to about 80° C./min, about 40° C./min to about 100° C./min, about 50° C./min to about 60° C./min, about 50° C./min to about 80° C./min, about 50° C./min to about 100° C./min, about 60° C./min to about 80° C./min, about 60° C./min to about 100° C./min, or about 80° C./min to about 100° C./min. The rate of change of temperature (increasing temperature or decreasing temperature) for the temperature gradient may be about 0.1° C./min, about 0.2° C./min, about 0.5° C./min, about 0.8° C./min, about 1° C./min, about 2° C./min, about 5° C./min, about 10° C./min, about 15° C./min, about 20° C./min, about 30° C./min, about 40° C./min, about 50° C./min, about 60° C./min, about 80° C./min, or about 100° C./min.

A heating step of the thermal treatment as disclosed herein (e.g., at a fixed temperature or over a temperature gradient) may last at least about 0.5 second, 1 second, 2 seconds, 3 seconds, 4 seconds, 5 seconds, 6 seconds, 7 seconds, 8 seconds, seconds, 10 seconds, 15 seconds, 20 seconds, 25 seconds, 30 seconds, 40 seconds, 50 seconds, 60 seconds, 2 minutes, 3 minutes, 4 minutes, 5 minutes, 10 minutes, 15 minutes, 20 minutes, 30 minutes, 40 minutes, 50 minutes, 60 minutes, 70 minutes, 80 minutes, 90 minutes, 100 minutes, 110 minutes, 120 minutes, or more. A heating step of the thermal treatment as disclosed herein may last at most about 120 minutes, 110 minutes, 100 minutes, 90 minutes, 80 minutes, 70 minutes, 60 minutes, 50 minutes, 40 minutes, 30 minutes, 20 minutes, 15 minutes, 10 minutes, 5 minutes, 4 minutes, 3 minutes, 2 minutes, 1 minute, or less.

A cooling step of the thermal treatment as disclosed herein (e.g., at a fixed temperature or over a temperature gradient) may last at least about 0.5 second, 1 second, 2 seconds, 3 seconds, 4 seconds, 5 seconds, 6 seconds, 7 seconds, 8 seconds, seconds, 10 seconds, 15 seconds, 20 seconds, 25 seconds, 30 seconds, 40 seconds, 50 seconds, 60 seconds, 2 minutes, 3 minutes, 4 minutes, 5 minutes, 10 minutes, 15 minutes, 20 minutes, 30 minutes, 40 minutes, 50 minutes, 60 minutes, 70 minutes, 80 minutes, 90 minutes, 100 minutes, 110 minutes, 120 minutes, or more. A cooling step of the thermal treatment as disclosed herein may last at most about 120 minutes, 110 minutes, 100 minutes, 90 minutes, 80 minutes, 70 minutes, 60 minutes, 50 minutes, 40 minutes, 30 minutes, 20 minutes, 15 minutes, 10 minutes, 5 minutes, 4 minutes, 3 minutes, 2 minutes, 1 minute, or less.

In some cases, the cooling step can be characterized by an average cooling rate that is slower than a threshold cooling rate. The cooling step can be performed, for example, subsequent to subjecting a nucleic acid molecule to an enzymatic treatment (e.g., for digestion of one or more specific nucleotides in the nucleic acid molecule, such as digestion of one or more Uracils of one or more adapters ligated to the nucleic acid molecule). The threshold cooling rate can be at least about 40° C./min, at least about 45° C./min, at least about 50° C./min, at least about 55° C./min, at least about 60° C./min, or more. The threshold cooling rate can be at most about 60° C./min, at most about 55° C./min, at most about 50° C./min, at most about 45° C./min, at most about 40° C./min, or less. For example, the cooling step can be characterized by an average cooling rate that is slower than a threshold cooling rate of about 50° C./min, such that the cooling step can be less than about 50° C./min, less than about 49° C./min, less than about 48° C./min, less than about 47° C./min, less than about 46° C./min, less than about 45° C./min, less than about 44° C./min, less than about 43° C./min, less than about 42° C./min, less than about 41° C./min, less than about 40° C./min, less than about 38° C./min, less than about 36° C./min, less than about 35° C./min, less than about 4° C./min, less than about 2° C./min, less than about 30° C./min, less than about 25° C./min, less than about 20° C./min, less than about 15° C./min, or less than about 10° C./min.

The thermal treatment may comprise at least one heating-and-cooling cycle, e.g., at least 1, 2, 3, 4, 5, 6, 7, 8, 9, 10, or more heating-and-cooling cycles. In an example, the thermal treatment may comprise a plurality of heating-and-cooling cycles. The heating-and-cooling cycles of the plurality of heating-and-cooling cycles may be the same. Alternatively, the heating-and-cooling cycles of the plurality of heating-and-cooling cycles may be different.

In some cases, the thermal treatment may comprise heating and cooling the sample in water bath. In such cases, cooling may not be controlled by active cooling device (e.g., Peltier element and/or heat sink), but after shutting down the heating element (e.g., turning off the heating water bath), passive cooling may be initiated by heat dissipating in air and/or slide-walls of the water tank. Thus, the cooling rate and/or speed may be adjusted empirically by controlling, e.g., the amount of water in the water bath. For example, a higher volume of water may require a longer time to cool down to room temperature, as compared to a smaller volume of water. As such, the cooling time can be adjusted to between about 15 minutes and about 60 minutes. In some cases, the thermal treatment may comprise heating and cooling the sample a thermocycler (e.g., in a polymerase chain reaction (PCR) thermocycler), in which the cooling rate (e.g., cooling ramp rate) may be precisely controlled by programming the cooling rate. For example, a cooling ramp rate of a thermocycler can be between about 0.1° C./second and about 5° C./second.

The at least one adapter as disclosed herein may be at least one heterologous adapter. At least a portion of the adapter as disclosed herein may exhibit complementarity to at least a portion of an end of a NA molecule. Subsequent to the thermal treatment as disclosed herein, the circularized NA molecule may be subjected to a ligation reaction. Upon the ligation reaction, (i) the two ends of the NA molecule (e.g., two heterologous adapters complexed to either side of the NA molecule) that have been hybridized to induce the circularization is covalently bonded (e.g., chemically or enzymatically) and/or (ii) the one or more heterologous adapters complexed to either side of the NA molecule are covalently bonded (e.g., chemically or enzymatically). The one or more NA molecules that remain linear may or may not be subjected to such ligation reaction.

Subsequent to complexation of the one or more adapters to the NA molecule, but prior to the circularization of the NA molecule, the one or more adapters may be modified, e.g., activated to promote the circularization of the NA molecule during the thermal treatment. Each adapter may comprise one or more target nucleobases (e.g., one or more Uracils) that can be removed (e.g., chemically or enzymatically), such that a free end of the adapter becomes an overhang (e.g., a sticky end). In an example, two heterologous adapters complexed to two ends of a NA molecule may be modified into two sticky ends, and the two heterologous adapters may be preconfigured such that the two sticky ends are complimentary cohesive ends that can form a complex to induce the circularization upon (or during) the thermal treatment. The overhang (or unpaired nucleobase(s)), as disclosed herein, may comprise at least 1, 2, 3, 4, 5, 6, 7, 8, 9, 10, 11, 12, 13, 14, 15, 16, 17, 18, 19, 20, 30, 40, 50, or more nucleobases. The overhang may comprise at most 50, 40, 30, 20, 19, 18, 17, 16, 15, 14, 13, 12, 11, 10, 9, 8, 7, 6, 5, 4, 3, 2, or 1 nucleobase.

The one or more target nucleobases removed from the adapter of the present disclosure (e.g., by one or more enzymes) may be the same or different. The one or more target nucleobases may comprise at least 1, 2, 3, 4, 5, 6, 7, 8, 9, 10, 15, 20, or more nucleobases per adapter. The one or more target nucleobases may comprise at most 20, 15, 10, 9, 8, 7, 6, 5, 4, 3, 2, or 1 nucleobase per adapter. The one or more target nucleobases may be removed chemically. The one or more target nucleobases may be removed by at least one enzyme. In some cases, the one or more target nucleobases may be removed by a plurality of enzymes, e.g., at least 2, 3, 4, 5, 6, 7, 8, 9, 10, or more enzymes. The plurality of enzymes may be separate enzymes (e.g., not fused to each other). Alternatively, the plurality of enzymes may be coupled to each other (e.g., fused to each other). The plurality of enzymes may be operatively coupled to each other. Non-limiting examples of such enzymes include uracil DNA glycosylase (UDG), methyl-binding domain glycosylase 4 (MBD4), thymine DNA glycosylase (TDG), 8-oxoguanine DNA glycosylase (OGG), FaPy-DNA glycosylase (FPG), MutY homolog DNA glycosylase (MYH/MUTYH), methylpurine DNA glycosylase (MPG), endonuclease III-like DNA glycosylase 1 (NTHL1), endonuclease VIII-like DNA glycosylase 1 (NEIL1), endonuclease VIII-like DNA glycosylase 2 (NEIL2), endonuclease VIII-like DNA glycosylase 3 (NEIL3), T4 pyrimidine dimer DNA glycosylase (T4 PDG), T4 endonuclease V, Mug-DNA glycosylase (MUG), alkyl adenine DNA glycosylase (AAG), SMUG DNA glycosylase (SMUG), endonuclease III, and endonuclease VIII. For example, the enzyme can be a fusion enzyme comprising (i) at least a portion of uracil DNA glycosylase (E. coli uracil DNA glycosylase) and (ii) endonuclease VIII (e.g., a USER enzyme).

Prior to complexation of the one or more adapters to the NA molecule, one or both ends of the NA molecule may be subjected to polyadenylation. The polyadenylation may be characterized by conjugating a plurality of adenosines (e.g., at least 2, 3, 4, 5, 6, 7, 8, 9, 10, 11, 12, 13, 14, 15, 16, 17, 18, 19, 20, 30, 40, 50, or more adenosines) to an end of the NA molecule.

Prior to complexation of the one or more adapters to the NA molecule (e.g., prior to the polyadenylation), one or both ends of the NA molecules may be repaired (e.g., blunting and phosphorylation of DNA ends). Alternatively or in addition to, one or more internal nicks (e.g., endogenous nicks or nicks resulting from NA fragmentation, such as shearing), may be repaired. In an example, shearing as disclosed herein can be subjecting one or more NA molecules to sonication.

An average NA size of the first plurality of NA molecules of the NA sample (e.g., prior to heterologous adapter ligation) may be at least about 0.1 kb, 0.2 kb, 0.3 kb, 0.4 kb, 0.5 kb, 1 kb, 2 kb, 5 kb, 10 kb, 15 kb, 20 kb, 30 kb, 40 kb, 50 kb, 100 kb, 200 kb, 300 kb, 400 kb, 500 kb, 600 kb, 700 kb, 800 kb, 900 kb, 1,000 kb, 2,000 kb, 5,000 kb, 10,000 kb, or more. An average NA size of the first plurality of NA molecules of the NA sample may be at most about 10,000 kb, 5,000 kb, 2,000 kb, 1,000 kb, 900 kb, 800 kb, 700 kb, 600 kb, 500 kb, 400 kb, 300 kb, 200 kb, 100 kb, 50 kb, 40 kb, 30 kb, 20 kb, 15 kb, 10 kb, 5 kb, 2 kb, 1 kb, 0.5 kb, 0.4 kb, 0.3 kb, 0.2 kb, 0.1 kb, or less.

An average NA size of the first plurality of NA molecules of the NA sample may be about 0.1 kb to about 500 kb. An average NA size of the first plurality of NA molecules may be at least about 0.1 kb. An average NA size of the first plurality of NA molecules may be at most about 500 kb. An average NA size of the plurality of NA molecules may be about 0.1 kb to about 0.2 kb, about 0.1 kb to about 0.3 kb, about 0.1 kb to about 0.4 kb, about 0.1 kb to about 0.5 kb, about 0.1 kb to about 1 kb, about 0.1 kb to about 10 kb, about 0.1 kb to about 20 kb, about 0.1 kb to about 50 kb, about 0.1 kb to about 100 kb, about 0.1 kb to about 200 kb, about 0.1 kb to about 500 kb, about 0.2 kb to about 0.3 kb, about 0.2 kb to about 0.4 kb, about 0.2 kb to about 0.5 kb, about 0.2 kb to about 1 kb, about 0.2 kb to about 10 kb, about 0.2 kb to about 20 kb, about 0.2 kb to about 50 kb, about 0.2 kb to about 100 kb, about 0.2 kb to about 200 kb, about 0.2 kb to about 500 kb, about 0.3 kb to about 0.4 kb, about 0.3 kb to about 0.5 kb, about 0.3 kb to about 1 kb, about 0.3 kb to about 10 kb, about 0.3 kb to about 20 kb, about 0.3 kb to about 50 kb, about 0.3 kb to about 100 kb, about 0.3 kb to about 200 kb, about 0.3 kb to about 500 kb, about 0.4 kb to about 0.5 kb, about 0.4 kb to about 1 kb, about 0.4 kb to about 10 kb, about 0.4 kb to about 20 kb, about 0.4 kb to about 50 kb, about 0.4 kb to about 100 kb, about 0.4 kb to about 200 kb, about 0.4 kb to about 500 kb, about 0.5 kb to about 1 kb, about 0.5 kb to about 10 kb, about 0.5 kb to about 20 kb, about 0.5 kb to about 50 kb, about 0.5 kb to about 100 kb, about 0.5 kb to about 200 kb, about 0.5 kb to about 500 kb, about 1 kb to about 10 kb, about 1 kb to about 20 kb, about 1 kb to about 50 kb, about 1 kb to about 100 kb, about 1 kb to about 200 kb, about 1 kb to about 500 kb, about 10 kb to about 20 kb, about 10 kb to about 50 kb, about 10 kb to about 100 kb, about 10 kb to about 200 kb, about 10 kb to about 500 kb, about 20 kb to about 50 kb, about 20 kb to about 100 kb, about 20 kb to about 200 kb, about 20 kb to about 500 kb, about 50 kb to about 100 kb, about 50 kb to about 200 kb, about 50 kb to about 500 kb, about 100 kb to about 200 kb, about 100 kb to about 500 kb, or about 200 kb to about 500 kb. An average NA size of the first plurality of NA molecules may be about 0.1 kb, about 0.2 kb, about 0.3 kb, about 0.4 kb, about 0.5 kb, about 1 kb, about 10 kb, about 20 kb, about 50 kb, about 100 kb, about 200 kb, or about 500 kb.

A concentration of the first plurality of NA molecules of the NA sample may be about 0.01 nM to about 10 nM. A concentration of the first plurality of NA molecules of the NA sample may be at least about 0.01 nM. A concentration of the first plurality of NA molecules of the NA sample may be at most about 10 nM. A concentration of the first plurality of NA molecules of the NA sample may be about 0.01 nM to about 0.02 nM, about 0.01 nM to about 0.05 nM, about 0.01 nM to about 0.08 nM, about 0.01 nM to about 0.1 nM, about 0.01 nM to about 0.5 nM, about 0.01 nM to about 1 nM, about 0.01 nM to about 2 nM, about 0.01 nM to about 5 nM, about 0.01 nM to about 10 nM, about 0.02 nM to about 0.05 nM, about 0.02 nM to about 0.08 nM, about 0.02 nM to about 0.1 nM, about 0.02 nM to about 0.5 nM, about 0.02 nM to about 1 nM, about 0.02 nM to about 2 nM, about 0.02 nM to about 5 nM, about 0.01 nM to about 10 nM, about 0.05 nM to about 0.08 nM, about 0.05 nM to about 0.1 nM, about 0.05 nM to about 0.5 nM, about 0.05 nM to about 1 nM, about 0.05 nM to about 2 nM, about 0.05 nM to about 5 nM, about 0.05 nM to about 10 nM, about 0.08 nM to about 0.1 nM, about 0.08 nM to about 0.5 nM, about 0.08 nM to about 1 nM, about 0.08 nM to about 2 nM, about 0.08 nM to about 5 nM, about 0.08 nM to about 10 nM, about 0.1 nM to about 0.5 nM, about 0.1 nM to about 1 nM, about 0.1 nM to about 2 nM, about 0.1 nM to about 5 nM, about 0.1 nM to about 10 nM, about 1 nM to about 2 nM, about 1 nM to about 5 nM, about 1 nM to about 10 nM, about 2 nM to about 5 nM, about 2 nM to about 10 nM, or about 5 nM to about 10 nM.

The NA sample may be subjected to NA fragmentation (e.g., shearing) to yield the average NA size as disclosed herein, e.g., prior to subjecting at least a portion of the NA sample to circularization. The NA fragmentation may yield a desired size distribution of NA molecules in the sample. In some cases, a number or a proportion of one or more NA molecules that are smaller than the size threshold and are circularized may depend on the size distribution of NA molecules in the sample. For example, conditions of fragmentation (e.g., ultrasonication intensity and/or time) may be tailored to bias the size distribution in the direction of long molecules (e.g., greater than or equal to the size threshold), or, vice versa, in the direction of short molecules (e.g., smaller than the size threshold). Thus, the conditions of fragmentation may be tailored to control the ratio between (i) the number or the proportion of the one or more NA molecules that are smaller than the size threshold and are circularized (SC) and (ii) a number or a proportion of one or more NA molecules that are greater than or equal to the size threshold and are uncircularized (GU). The ratio (CU:GU) may be at least about 100:1, 100:2, 100:3, 100:4, 100:5, 100:10, 100:20, 100:30, 100:40, 100:50, 100:60, 100:70, 100:80, 100:90, 100:100, 90:100, 80:100, 70:100, 60:100, 50:100, 40:100, 30:100, 20:100, 10:100, 5:100, 4:100, 3:100, 2:100, or 1:100. The ratio (CU:GU) may be at most about 100:1, 100:2, 100:3, 100:4, 100:5, 100:10, 100:20, 100:30, 100:40, 100:50, 100:60, 100:70, 100:80, 100:90, 100:100, 90:100, 80:100, 70:100, 60:100, 50:100, 40:100, 30:100, 20:100, 10:100, 5:100, 4:100, 3:100, 2:100, or 1:100. The ratio (CU:GU) may be about 100:1, 100:2, 100:3, 100:4, 100:5, 100:10, 100:20, 100:30, 100:40, 100:50, 100:60, 100:70, 100:80, 100:90, 100:100, 90:100, 80:100, 70:100, 60:100, 50:100, 40:100, 30:100, 20:100, 10:100, 5:100, 4:100, 3:100, 2:100, or 1:100.

Alternatively, the NA sample may naturally exhibit the average NA size as disclosed herein. In some examples, the NA sample may be derived from a subject.

FIG. 2 schematically illustrates an example of a method 201 for processing a nucleic acid sample. The method may comprise providing the NA sample comprising a plurality of NA molecules (process 210). The method may further comprise ligating a heterologous adapter to a NA molecule of the plurality of NA molecules (process 220). The method may further comprise subjecting the plurality of NA molecules to a thermal treatment, wherein the thermal treatment is sufficient to selectively circularize a NA molecules of the plurality of NA molecules that is smaller than a size threshold, such that an additional NA molecule of the plurality of NA molecules that is bigger than or equal to the size threshold remains linear (process 230). Both (i) the NA molecule that is circularized and (ii) the additional NA molecule that remains linear may be usable for sequencing. Optionally, the method may further comprise subjecting both (i) the circularized NA molecule and (ii) the linear additional NA molecule to sequencing (e.g., to different sequencing modalities).

In another aspect, the present disclosure provides a NA composition comprising any or all of the byproduct of any of the methods disclosed herein. In an example, the NA composition may comprise at least two groups of NA molecules that are simultaneously generated by any of the methods disclosed herein, the at least two groups comprising (i) a first group comprising a circularized NA molecule that is smaller than the size threshold and (ii) a second group comprising an uncircularized NA molecule that is bigger than or equal to the size threshold.

In another aspect, the present disclosure provides a kit for executing at least a portion of the methods disclosed herein. For example, the kit may comprise the one or more heterologous adapters. Alternatively or in addition to, the kit may comprise one or more components to perform the sequencing (e.g., polymerase for performing sequencing-by-synthesis methods, primers for sequencing, etc.).

In another aspect, the present disclosure provides a system configured to process the NA sample in accordance with any of the methods disclosed herein. For example, the system may comprise a chamber operatively coupled to a temperature regulator, such that a NA molecule complexed with one or more heterologous adapters can be subjected to a thermal treatment in a controlled environment. Alternatively or in addition to, the system may comprise one or more sequencing instruments to perform sequencing of the NA templates, as disclosed herein.

II. Sample

Samples for processing and analysis, as disclosed herein, can comprise a plurality of polynucleotides. A polynucleotide can be single stranded DNA, double stranded DNA, or a combination thereof. The polynucleotides can comprise genomic DNA, genomic cDNA, cell free DNA, cell free cDNA, or a combination of any of the foregoing.

A polynucleotide can include cell-free DNA, circulating tumor DNA, genomic DNA, and DNA from formalin fixed and paraffin embedded (FFPE) samples. In some examples, an extracted DNA from a FFPE sample may be damaged, and such damaged DNA may be repaired by an available FFPE DNA repair kit. A sample can comprise any suitable DNA and/or cDNA sample such as for example, urine, stool, blood, saliva, tissue, biopsy, bodily fluid, or tumor cells.

The plurality of polynucleotides can be single-stranded or double-stranded.

A polynucleotide sample can be derived from any suitable source. For example, a sample can be obtained from a patient, from an animal, from a plant, or from the environment such as, for example, a naturally occurring or artificial atmosphere, a water system, soil, an atmospheric pathogen collection system, a sub-surface sediment, groundwater, or a sewage treatment plant.

Polynucleotides from a sample may include one more different polynucleotides, such as, for example, DNA, RNA, ribosomal RNA (rRNA), transfer RNA (tRNA), micro RNA (miRNA), messenger RNA (mRNA), fragments of any of foregoing, or combinations of any of the foregoing. A sample can comprise DNA. A sample can comprise genomic DNA. A sample can comprise mitochondrial DNA, chloroplast DNA, plasmid DNA, bacterial artificial chromosomes, yeast artificial chromosomes, oligonucleotide tags, or a combination of any of the foregoing.

The polynucleotides may be single-stranded, double-stranded, or a combination thereof. A polynucleotide can be a single-stranded polynucleotide, which may or may not be in the presence of double-stranded polynucleotides.

The starting amount of polynucleotides in a sample can be, for example, less than 50 ng, such as less than 45 ng, 40 ng, 35 ng, 30 ng, 25 ng, 20 ng, 15 ng, 10 ng, 5 ng, 4 ng, 3 ng, 2 ng, 1 ng, 0.5 ng, 0.1 ng, or less. The starting amount of polynucleotides in a sample can be, for example, more than 0.1 ng, such as more than 0.5 ng, 1 ng, 2 ng, 3 ng, 4 ng, 5 ng, 10 ng, 15 ng, 20 ng, 25 ng, 30 ng, 35 ng, 40 ng, 45 ng, 50 ng, or more. An amount of starting polynucleotides can be, for example, from 0.1 ng to 100 ng, from 1 ng to 75 ng, 5 ng to 50 ng, or from 10 ng to 20 ng.

The polynucleotides in a sample can be single-stranded, either as obtained or by way of treatment (e.g., denaturation). Further examples of suitable polynucleotides are described herein, such as with respect to any of the various aspects of the disclosure. Polynucleotides can be subjected to subsequent steps (e.g., circularization and amplification) without an extraction step, and/or without a purification step. For example, a fluid sample may be treated to remove cells without an extraction step to produce a purified liquid sample and a cell sample, followed by isolation of the polynucleotides from the purified fluid sample. A variety of procedures for isolation of polynucleotides are available, such as by precipitation or non-specific binding to a substrate followed by washing the substrate to release bound polynucleotides. Where polynucleotides are isolated from a sample without a cellular extraction step, polynucleotides will largely be extracellular or "cell-free" polynucleotides, which may correspond to dead or damaged cells. The identity of such cells may be used to characterize the cells or population of cells from which they are derived, such as in a microbial community.

A sample can be from a subject. A subject can be any suitable organism including, for example, plants, animals, fungi, protists, monerans, viruses, mitochondria, and chloroplasts. Sample polynucleotides can be isolated from a subject, such as a cell sample, tissue sample, bodily fluid sample, or organ sample or cell cultures derived from any of these, including, for example, cultured cell lines, biopsy, blood sample, cheek swab, or fluid sample containing a cell such as saliva. The subject may be an animal such as a cow, a pig, a mouse, a rat, a chicken, a cat, a dog, or a mammal, such as a human. A sample can comprise tumor cells, such as in a sample of tumor tissue from a subject.

A sample may not comprise intact cells, can be treated to remove cells, or polynucleotides are isolated without a cellular extractions step such as to isolate cell-free polynucleotides, such as cell-free DNA.

Other examples of sample sources include those from blood, urine, feces, nares, the lungs, the gut, other bodily fluids or excretions, a derivative thereof, or a combination thereof.

A sample from a single individual can be divided into multiple separate samples, such as 2, 3, 4, 5, 6, 7, 8, 9, 10, or more separate samples that are subjected to methods of the disclosure independently, such as analysis in duplicate, triplicate, quadruplicate, or more. Where a sample is from a subject, a reference sequence may also be derived from the subject, such as a consensus sequence from the sample under analysis or the sequence of polynucleotides from another sample or tissue of the same subject. For example, a blood sample may be analyzed for ctDNA mutations, and cellular DNA from another sample from the subject such as a buccal or skin sample, can be analyzed to determine a reference sequence.

Polynucleotides can be extracted from a sample, with or without extraction from cells in a sample, according to any suitable method.

A plurality of polynucleotides can comprise cell-free polynucleotides, such as cell-free DNA (cfDNA) or circulating tumor DNA (ctDNA). Cell-free DNA circulates in both healthy and diseased individuals. cfDNA from tumors (ctDNA) is not confined to any specific cancer type, but appears to be a common finding across different malignancies. The free circulating DNA concentration in plasma can be lower in control subjects in comparison to that in patients having or suspected of having a condition. In an example, the free circulating DNA concentration in plasma can be, for example, from 14 ng/ml to 18 ng/mL in control subjects and from 18 ng/ml to 318 ng/mL in patients with neoplasia.

Apoptotic and necrotic cell death may contribute to cell-free circulating DNA in bodily fluids. For example, significantly increased circulating DNA levels may be observed in plasma of prostate cancer patients and other prostate diseases, such as Benign Prostate Hyperplasia and Prostatits. In addition, circulating tumor DNA may be present in fluids originating from the organs where the primary tumor occurs. In an example, breast cancer detection can be achieved in ductal lavages; colorectal cancer detection in stool; lung cancer detection in sputum, and prostate cancer detection in urine or ejaculate. Cell-free DNA may be obtained from a variety of sources. An example source may be blood samples of a subject. However, cfDNA or other fragmented DNA may be derived from a variety of other sources including, for example, urine and stool samples can be a source of cfDNA, including ctDNA.

III. Nanopore

A sequencing system can include a reaction chamber that includes one or more nanopore devices. A nanopore device may be an individually addressable nanopore device. An individually addressable nanopore can be individually readable. An individually addressable nanopore can be individually writable. An individually addressable nanopore can be individually readable and individually writable. The system can include one or more computer processors for facilitating sample preparation and various operations of the disclosure, such as polynucleotide sequencing. The processor can be coupled to nanopore device.

A nanopore device may include a plurality of individually addressable sensing electrodes. Each sensing electrode can include a membrane adjacent to the electrode, and one or more nanopores in the membrane. A nanopore may be in a membrane such as a lipid bi-layer disposed adjacent or in sensing proximity to an electrode that is part of, or coupled to, an integrated circuit. A nanopore may be associated with an individual electrode and sensing integrated circuit or a plurality of electrodes and sensing integrated circuits. A nanopore can comprise a solid state nanopore.

Devices and systems for use in methods provided by the present disclosure may accurately detect individual nucleotide incorporation events, such as upon the incorporation of a nucleotide into a growing strand that is complementary to a template. An enzyme such as a DNA polymerase, RNA polymerase, or ligase can incorporate nucleotides to a growing polynucleotide chain. Enzymes such as polymerases can generate polynucleotide strands.

The added nucleotide can be complimentary to the corresponding template polynucleotide strand which is hybridized to the growing strand. A nucleotide can include a tag or tag species that is coupled to any location of the nucleotide including, but not limited to a phosphate such as a γ-phosphate, sugar or nitrogenous base moiety of the nucleotide. In some cases, tags are detected while tags are associated with a polymerase during the incorporation of nucleotide tags. The tag may continue to be detected until the tag translocates through the nanopore after nucleotide incorporation and subsequent cleavage and/or release of the tag. Nucleotide incorporation events can release tags from the nucleotides which pass through a nanopore and are detected. A tag can be released by the polymerase, or cleaved/released in any suitable manner including without limitation cleavage by an enzyme located near the polymerase. In this way, the incorporated base may be identified (i.e., A, C, G, T or U) because a unique tag is released from each type of nucleotide (i.e., adenine, cytosine, guanine, thymine or uracil). In nucleotide incorporation events that do not release, a tag coupled to an incorporated nucleotide is detected with the aid of a nanopore. In some examples, the tag can move through or in proximity to the nanopore and be detected with the aid of the nanopore.

Methods and systems of the disclosure can enable the detection of polynucleotide incorporation events, such as at a resolution of at least 1, 2, 3, 4, 5, 6, 7, 8, 9, 10, 20, 30, 40, 50, 100, 500, 1000, 5000, 10000, 50000, or 100000 polynucleotide bases within a given time period. For example, a nanopore device can be used to detect individual polynucleotide incorporation events, with each event being associated with an individual nucleic acid base. In other examples, a nanopore device can be used to detect an event that is associated with a plurality of bases. For example, a signal sensed by the nanopore device can be a combined signal from at least 2, 3, 4, or 5 bases.

In certain sequencing methods, tags do not pass through the nanopore. The tags can be detected by the nanopore and exit the nanopore without passing through the nanopore such as exiting from the inverse direction from which the tag entered the nanopore. A sequencing device can be configured to actively expel the tags from the nanopore.

In certain sequencing methods tags are not released upon nucleotide incorporation events. Nucleotide incorporation events can present tags to a nanopore without releasing the tags. The tags can be detected by the nanopore without being released. The tags may be attached to the nucleotides by a linker of sufficient length to present the tag to the nanopore for detection.

Nucleotide incorporation events may be detected in real-time as they occur by a nanopore. An enzyme such as a DNA polymerase attached to or in proximity to a nanopore can facilitate the flow of a polynucleotide through or adjacent to a nanopore. A nucleotide incorporation event, or the incorporation of a plurality of nucleotides, may release or present one or more tags, which may be detected by a nanopore. Detection can occur as the tags flow through or adjacent to the nanopore, as the tags reside in the nanopore and/or as the tags are presented to the nanopore. In some cases, an enzyme attached to or in proximity to the nanopore may aid in detecting tags upon the incorporation of one or more nucleotides.

A tag can be an atom, a molecule, a collection of atoms, or a collection of molecules. A tag may provide an optical, electrochemical, magnetic, or electrostatic such as an inductive or capacitive, signature, which signature may be detected with the aid of a nanopore.

The nanopore may be formed or otherwise embedded in a membrane disposed adjacent to a sensing electrode of a sensing circuit, such as an integrated circuit. An integrated circuit may be an application specific integrated circuit (ASIC). An integrated circuit can be a field effect transistor or a complementary metal-oxide semiconductor (CMOS). A sensing circuit may be situated in a chip or other device having the nanopore, or off of the chip or device, such as in an off-chip configuration.

As a nucleic acid or tag flows through or adjacent to the nanopore, the sensing circuit detects an electrical signal associated with the nucleic acid or tag. The nucleic acid may be a subunit of a larger strand. The tag may be a byproduct of a nucleotide incorporation event or other interaction between a tagged nucleic acid and the nanopore or a species adjacent to the nanopore, such as an enzyme that cleaves a tag from a nucleic acid. The tag may remain attached to the nucleotide. A detected signal may be collected and stored in a memory location, and later used to construct a sequence of the nucleic acid. The collected signal may be processed to account for any abnormalities in the detected signal, such as errors.

Nanopores may be used to sequence polynucleotides indirectly, in some cases with electrical detection. Indirect sequencing may be any method where an incorporated nucleotide in a growing strand does not pass through the nanopore. The polynucleotide may pass within any suitable distance from and/or proximity to the nanopore, in some cases within a distance such that tags released from nucleotide incorporation events are detected in the nanopore.

Byproducts of nucleotide incorporation events may be detected by the nanopore. Nucleotide incorporation events refer to the incorporation of a nucleotide into a growing polynucleotide chain. A byproduct may be correlated with the incorporation of a given type nucleotide. Nucleotide incorporation events can be catalyzed by an enzyme, such as DNA polymerase, and use base pair interactions with a template molecule to choose amongst the available nucleotides for incorporation at each location.

A nucleic acid sample may be sequenced using tagged nucleotides or nucleotide analogs. In some examples, a method for sequencing a nucleic acid molecule comprises (a) incorporating (e.g., polymerizing) tagged nucleotides, wherein a tag associated with an individual nucleotide is released upon incorporation, and (b) detecting the released tag with the aid of a nanopore. In some instances, the method further comprises directing the tag attached to or released from an individual nucleotide through the nanopore. The released or attached tag may be directed by any suitable technique, in some cases with the aid of an enzyme (or molecular motor) and/or a voltage difference across the pore. Alternative, the released or attached tag may be directed through the nanopore without the use of an enzyme. For example, the tag may be directed by a voltage difference across the nanopore as described herein.

A tag may be detected with the aid of a nanopore device having at least one nanopore in a membrane. The tag may be associated with an individual tagged nucleotide during incorporation of the individual tagged nucleotide. A nanopore device can detect a tag associated with an individual tagged nucleotide during incorporation. The tagged nucleotides, whether incorporated into a growing nucleic acid strand or unincorporated, can be detected, determined, or differentiated for a given period of time by the nanopore device, in some cases with the aid of an electrode and/or nanopore of the nanopore device. The time period within which the nanopore device detects the tag may be shorter, in some cases substantially shorter, than the time period in which the tag and/or nucleotide coupled to the tag is held by an enzyme, such as an enzyme facilitating the incorporation of the nucleotide into a nucleic acid strand (e.g., a polymerase). A tag can be detected by the electrode a plurality of times within the time period that the incorporated tagged nucleotide is associated with the enzyme. For instance, the tag can be detected by the electrode at least 1, 2, 3, 4, 5, 6, 7, 8, 9, 10, 20, 30, 40, 50, 60, 70, 80, 90, 100, 200, 300, 400, 500, 1000, 10,000, 100,000, or 1,000,000 times within the time period that the incorporated tagged nucleotide is associated with the enzyme.

Sequencing can be accomplished using pre-loaded tags. Pre-loading a tag can comprise directing at least a portion of the tag through at least a portion of a nanopore while the tag can be attached to a nucleotide, which nucleotide has been incorporated into a nucleic acid strand (e.g., growing nucleic acid strand), is undergoing incorporation into the nucleic acid strand, or has not yet been incorporated into the nucleic acid strand but may undergo incorporation into the nucleic acid strand. Pre-loading a tag can comprise directing at least a portion of the tag through at least a portion of the nanopore before the nucleotide has been incorporated into the nucleic acid strand or while the nucleotide is being incorporated into the nucleic acid strand. Pre-loading a tag can include directing at least a portion of the tag through at least a portion of the nanopore after the nucleotide has been incorporated into the nucleic acid strand.

A tag associated with an individual nucleotide can be detected by a nanopore without being released from the nucleotide upon incorporation. Tags can be detected without being released from incorporated nucleotides during synthesis of a nucleic acid strand that is complementary to a target strand. The tags can be attached to the nucleotides with a linker such that the tag is presented to the nanopore (e.g., the tag hangs down into or otherwise extend through at least a portion of the nanopore). The length of the linker may be sufficiently long so as to permit the tag to extend to or through at least a portion of the nanopore. In some instances, the tag is presented to (i.e., moved into) the nanopore by a voltage difference. Other ways to present the tag into the pore may also be suitable (e.g., use of enzymes, magnets, electric fields, pressure differential). In some instances, no active force is applied to the tag (i.e., the tag diffuses into the nanopore).

A chip for sequencing a nucleic acid sample can comprise a plurality of individually addressable nanopores. An individually addressable nanopore of the plurality can contain at least one nanopore formed in a membrane disposed adjacent to an integrated circuit. Each individually addressable nanopore can be capable of detecting a tag associated with an individual nucleotide. The nucleotide can be incorporated (e.g., polymerized) and the tag may not be released from the nucleotide upon incorporation.

Tags can be presented to the nanopore upon nucleotide incorporation events and are released from the nucleotide. The released tags can go through the nanopore. The tags do not pass through the nanopore in some instances. A tag that has been released upon a nucleotide incorporation event is distinguished from a tag that may flow through the nanopore, but has not been released upon a nucleotide incorporation event at least in part by the dwell time in the nanopore. In some cases, tags that dwell in the nanopore for at least 100 milliseconds (ms) are released upon nucleotide incorporation events and tags that dwell in the nanopore for less than 100 ms are not released upon nucleotide incorporation events. Tags may be captured and/or guided through the nanopore by a second enzyme or protein (e.g., a nucleic acid binding protein). The second enzyme may cleave a tag upon (e.g., during or after) nucleotide incorporation. A linker between the tag and the nucleotide may be cleaved.

A tag that is coupled to an incorporated nucleotide is distinguished from a tag associated with a nucleotide that has not been incorporated into a growing complementary strand based on the residence time of the tag in the nanopore or a signal detected from the unincorporated nucleotide with the aid of the nanopore. An unincorporated nucleotide may generate a signal (e.g., voltage difference, current) that is detectable for a time period between 1 nanosecond (ns) and 100 ms, or between 1 ns and 50 ms, whereas an incorporated nucleotide may generate a signal with a lifetime between 50 ms and 500 ms, or 100 ms and 200 ms. An unincorporated nucleotide may generate a signal that is detectable for a time period between 1 ns and 10 ms, or 1 ns and 1 ms. An unincorporated tag is detectable by a nanopore for a time period (average) that is longer than the time period in which an incorporated tag is detectable by the nanopore.

Incorporated nucleic acids can be detected by and/or are detectable by the nanopore for a shorter period of time than an un-incorporated nucleotide. Alternatively, incorporated nucleic acids can be detected by and/or are detectable by the nanopore for a longer period of time than an un-incorporated nucleotide. The difference and/or ratio between these times can be used to determine whether a nucleotide detected by the nanopore is incorporated or not, as described herein.

The detection period can be based on the free-flow of the nucleotide through the nanopore; an unincorporated nucleotide may dwell at or in proximity to the nanopore for a time period between 1 nanosecond (ns) and 100 ms, or between 1 ns and 50 ms, whereas an incorporated nucleotide may dwell at or in proximity to the nanopore for a time between 50 ms and 500 ms, or 100 ms and 200 ms. The time periods can vary based on processing conditions; however, an incorporated nucleotide may have a dwell time that is greater than that of an unincorporated nucleotide.

A tag or tag species can include a detectable atom or molecule, or a plurality of detectable atoms or molecules. A tag can include a one or more adenine, guanine, cytosine, thymine, uracil, or a derivative thereof linked to any position including a phosphate group, sugar or a nitrogenous base of a nucleic acid molecule. A tag can include one or more adenine, guanine, cytosine, thymine, uracil, or a derivative thereof covalently linked to a phosphate group of a nucleic acid base.

A tag can have a length of at least 0.1 nanometers (nm), 1 nm, 2 nm, 3 nm, 4, nm, 5 nm, 6 nm, 7 nm, 8 nm, 9 nm, 10 nm, 20 nm, 30 nm, 40 nm, 50 nm, 60 nm, 70 nm, 80 nm, 90 nm, 100 nm, 200 nm, 300 nm, 400 nm, 500 nm, or 1000 nm.

A tag can include a tail of repeating subunits, such as a plurality of adenine, guanine, cytosine, thymine, uracil, or a derivative thereof. For example, a tag can include a tail portion having at least 2, 3, 4, 5, 6, 7, 8, 9, 10, 20, 30, 40, 50, 60, 70, 80, 90, 100, 1000, 10,000, or 100,000 subunits of adenine, guanine, cytosine, thymine, uracil, or a derivative thereof. The subunits can be linked to one another, and at a terminal end linked to a phosphate group of the nucleic acid. Other examples of tag portions include any polymeric material, such as polyethylene glycol (PEG), polysulfonates, amino acids, or any completely or partially positively charged, negatively charged, or un-charged polymer.

A tag as disclosed herein may include radioactive isotopes, fluorescent labels, chemiluminescent labels, bioluminescent labels and enzyme labels. Non-limiting examples of a tag (e.g., a fluorescent tag) may include fluorescein, 5-carboxyfluorescein (FAM), 2'7'-dimethoxy-4'5-dichloro-6-carboxyfluorescein (JOE), rhodamine, 6-carboxyrhodamine (R6G), N,N,N',N'-tetramethyl-6-carboxyrhodamine (TAMRA), 6-carboxy-X-rhodamine (ROX), 4-(4' dimethylaminophenylazo)benzoic acid (DABCYL), Cascade Blue, Oregon Green, Texas Red, Cyanine and 5-(2'-aminoethyl) aminonaphthalene-1-sulfonic acid (EDANS), [R6G]dUTP, [TAMRA]dUTP, [R110]dCTP, [R6G]dCTP, [TAMRA]dCTP, [JOE]ddATP, [R6G]ddATP, [FAM]ddCTP, [R110]ddCTP, [TAMRA]ddGTP, [ROX]ddTTP, [dR6G]ddATP, [dR110]ddCTP, [dTAMRA]ddGTP, and [dROX]ddTTP available from Perkin Elmer, Foster City, Calif; FluoroLink Deoxy Nucleotides, FluoroLink Cy3-dCTP, FluoroLink Cy5-dCTP, FluoroLink Fluor X-dCTP, FluoroLink Cy3-dUTP, and FluoroLink Cy5-dUTP available from Amersham, Arlington Heights, Ill.; Fluorescein-15-dATP, Fluorescein-12-dUTP, Tetramethyl-rodamine-6-dUTP, IR 770-9-dATP, Fluorescein-12-ddUTP, Fluorescein-12-UTP, and Fluorescein-15-2'-dATP available from Boehringer Mannheim, Indianapolis, Ind.; and Chromosome Labeled Nucleotides, BODIPY-FL-14-UTP, BODIPY-FL-4-UTP, BODIPY-TMR-14-UTP, BODIPY-TMR-14-dUTP, BODIPY-TR-14-UTP, BODIPY-TR-14-dUTP, Cascade Blue-7-UTP, Cascade Blue-7-dUTP, fluorescein-12-UTP, fluorescein-12-dUTP, Oregon Green 488-5-dUTP, Rhodamine Green-5-UTP, Rhodamine Green-5-dUTP, tetramethylrhodamine-6-UTP, tetramethylrhodamine-6-dUTP, Texas Red-5-UTP, Texas Red-5-dUTP, and Texas Red-12-dUTP.

IV. Polymerase

A DNA polymerase can be bound to the 3' end of a gap of the NA molecule as disclosed herein (e.g., 3' end of a heterologous gap of the circularized NA molecule). DNA sequencing can be accomplished by using an enzyme such as a DNA polymerize to amplify and transcribe a polynucleotide in proximity to a nanopore and tagged nucleotides. Sequencing methods can involve incorporating or polymerizing tagged nucleotides using a polymerase such as a DNA polymerase, or transcriptase. The polymerase can be mutated to allow it to accept tagged nucleotides. The polymerase can also be mutated to increase the time for which the tag is detected by the nanopore.

A sequencing enzyme can be, for example, any suitable enzyme that creates a polynucleotide strand by phosphate linkage of nucleotides. The DNA polymerase can be, for example, a 9°Nm™ polymerase or a variant thereof, an *E. Coli* DNA polymerase I, a Bacteriophage T4 DNA polymerase, a Sequenase, a Taq DNA polymerase, a 9°Nm™ polymerase (exo-) A485L/Y409V, a $\phi$29 DNA Polymerase, a Bst DNA polymerase, or variants, mutants, or homologs of any of the foregoing. A homolog can have any suitable percentage homology such as, for example, at least 30%, at least 40%, at least 50%, at least 60%, at least 70%, at least 80%, at least 90%, or at least 95% sequence identity.

In some examples, for nanopore sequencing, a polymerization enzyme can be attached to or situated in proximity to a nanopore. Suitable methods for attaching the polymerization enzyme to a nanopore include cross-linking the enzyme to the nanopore or in proximity to the nanopore such as via the formation of intra-molecular disulfide bonds. The nanopore and the enzyme may also be a fusion such as an encoded by a single polypeptide chain. Methods for producing fusion proteins may include fusing the coding sequence for the enzyme in frame and adjacent to the coding sequence for the nanopore and expressing this fusion sequence from a single promoter. A polymerization enzyme can be attached or coupled to a nanopore using molecular staples or protein fingers. A polymerization enzyme can be attached to a nanopore via an intermediate molecule, such as for example biotin conjugated to both the enzyme and the nanopore with streptavidin tetramers linked to both biotins. The intermediate molecule can be referred to as a linker.

The sequencing enzyme can also be attached to a nanopore with an antibody. Proteins that form a covalent bond between each other can be used to attach a polymerase to a nanopore. Phosphatase enzymes or an enzyme that cleaves a tag from a nucleotide can also be attached to the nanopore.

The polymerase can be mutated to facilitate and/or to improve the efficiency of the mutated polymerase for incorporation of tagged nucleotides into a growing polynucleotide relative to the non-mutated polymerase. The polymerase can be mutated to improve entry of the nucleotide analog such as a tagged nucleotide, into the active site region of the polymerase and/or mutated for coordinating with the nucleotide analogs in the active region.

Other mutations such as amino acid substitutions, insertions, deletions, and/or exogenous features to a polymerize can result in enhanced metal ion coordination, reduced exonuclease activity, reduced reaction rates at one or more steps of the polymerase kinetic cycle, decreased branching fraction, altered cofactor selectivity, increased yield, increased thermostability, increased accuracy, increased speed, increased read length, increased salt tolerance relative to the non-mutated polymerase.

A suitable polymerase can have a kinetic rate profile that is suitable for detection of the tags by a nanopore. The rate profile generally refers to the overall rate of nucleotide incorporation and/or a rate of any step of nucleotide incorporation such as nucleotide addition, enzymatic isomerization such as to or from a closed state, cofactor binding or release, product release, incorporation of polynucleotide into the growing polynucleotide, or translocation.

A polymerase can be adapted to permit the detection of sequencing events. The rate profile of a polymerase can be such that a tag is loaded into (and/or detected by) the nanopore for an average of 0.1 milliseconds (ms), 1 ms, 5 ms 10 ms, 20 ms, 30 ms, 40 ms, 50 ms, 60 ms, 80 ms, 100 ms, 120 ms, 140 ms, 160 ms, 180 ms, 200 ms, 220 ms, 240 ms, 260 ms, 280 ms, 300 ms, 400 ms, 500 ms, 600 ms, 800 ms, or 1000 ms. For example, the rate profile of a polymerase can be such that a tag is loaded into and/or detected by the nanopore for an average of at least 5 ms, at least 10 ms, at least 20 ms, at least 30 ms, at least 40 ms, at least 50 ms, at least 60 ms, at least 80 ms, at least 100 ms, at least 120 ms, at least 140 ms, at least 160 ms, at least 180 ms, at least 200 ms, at least 220 ms, at least 240 ms, at least 260 ms, at least 280 ms, at least 300 ms, at least 400 ms, at least 500 ms, at least 600 ms, at least 800 ms, or at least 1000 ms. A tag can be detected by the nanopore for an average between 80 ms and 260 ms, between 100 ms and 200 ms, or between 100 ms and 150 ms.

A nanopore/polymerase complex can be configured to permit the detection of one or more events associated with amplification and transcription of the circular polynucleotide. The one or more events may be kinetically observable and/or non-kinetically observable such as a nucleotide migrating through a nanopore without coming in contact with a polymerase.

In some cases, the polymerase reaction exhibits two kinetic steps which proceed from an intermediate in which a nucleotide or a polyphosphate product is bound to the polymerase enzyme, and two kinetic steps which proceed from an intermediate in which the nucleotide and the polyphosphate product are not bound to the polymerase enzyme. The two kinetic steps can include enzyme isomerization, nucleotide incorporation, and product release. In some cases, the two kinetic steps are template translocation and nucleotide binding.

A suitable polymerase can exhibit strong or enhanced strand displacement.

V. Identification of Sequence Variants

Methods provided by the present disclosure can be used to identify sequence variants in a polynucleotide sample. A sequence difference between sequencing reads and a reference sequence is referred to as a genuine sequence variant if the sequence difference occurs in at least two different polynucleotides, e.g., two different circular polynucleotides, which can be distinguished as a result of having different junctions. Because the position and type of a sequence variant that are the result of amplification or sequencing errors are unlikely to be duplicated exactly on two different polynucleotides comprising the same target sequence, including this validation parameter can reduce the background of erroneous sequence variants, with a concurrent increase in the sensitivity and accuracy of detecting actual sequence variation in a sample. A sequence variant can have a frequency less than 5%, 4%, 3%, 2%, 1.5%, 1%, 0.75%, 0.5%, 0.25%, 0.1%, 0.075%, 0.05%, 0.04%, 0.03%, 0.02%, 0.01%, 0.005%, 0.001%, or lower is sufficiently above background to permit an accurate identification. A sequence variant can occur with a frequency of less than 0.1%. The frequency of a sequence variant can be sufficiently above background when such frequency is statistically significantly above the background error rate, for example, with a p-value less than 0.05, 0.01, 0.001, or 0.0001. The frequency of a sequence variant can be sufficiently above background when the frequency is at least 2-fold, 3-fold, 4-fold, 5-fold, 6-fold, 7-fold, 8-fold, 9-fold, 10-fold, 25-fold, 50-fold, 100-fold, or more above the background error rate. The background error rate for accurately determining the sequence at a given position can be less than 1%, 0.5%, 0.1%, 0.05%, 0.01%, 0.005%, 0.001%, or 0.0005%.

Identifying a sequence variant can comprise optimally aligning one or more sequencing reads with a reference sequence to identify differences between the two, as well as to identify junctions. Alignment can involve placing one sequence along another sequence, iteratively introducing gaps along each sequence, scoring how well the two sequences match, and repeating for various positions along the reference. The best-scoring match is deemed to be the alignment and represents an inference about the degree of relationship between the sequences.

A reference sequence to which sequencing reads are compared is a reference genome, such as the genome of a member of the same species as the subject. A reference genome may be complete or incomplete. A reference genome can consist only of regions containing target polynucleotides, such as from a reference genome or from a consensus generated from sequencing reads under analysis. A reference sequence can comprise or can consist of sequences of polynucleotides of one or more organisms, such as sequences from one or more bacteria, archaea, viruses, protists, fungi, or other organism. A reference sequence can consist of only a portion of a reference genome, such as regions corresponding to one or more target sequences under analysis. For example, for detection of a pathogen, a reference genome can be the entire genome of the pathogen, or a portion thereof useful in identification, such as of a particular strain or serotype. A sequencing read can be aligned to multiple different reference sequences, such as to screen for multiple different organisms or strains.

VI. Therapeutic Applications

Methods, systems, and compositions provided herein can be directed to one or more therapeutic applications, such as in the characterization of a patient sample and optionally diagnosis of a condition of a subject. Therapeutic applications can include informing the selection of therapies to which a patient may be most responsive and/or treatment of a subject in need of therapeutic intervention based on the results of methods provided by the present disclosure.

For example, methods provided by the present disclosure can be used to diagnose tumor presence, progression and/or metastasis of tumors, such as when the polynucleotides analyzed comprise or consist of cfDNA, ctDNA, or fragmented tumor DNA. A subject may be monitored for tumor treatment efficacy, for example, by monitoring ctDNA over time, a decrease in ctDNA can be used as an indication of treatment efficacy, and increases in ctDNA can inform selection of different treatments and/or different dosages. Other uses include evaluations of organ rejection in transplant recipients such as where increases in the amount of circulating DNA corresponding to the transplant donor genome is used as an early indicator of transplant rejection, and genotyping/isotyping of pathogen infections, such as viral or bacterial infections. Detection of sequence variants in circulating fetal DNA may be used to diagnose a condition of a fetus.

Methods provided by the present disclosure can comprise diagnosing a subject based on a result of the sequencing, such as diagnosing the subject with a disease associated with a detected causal genetic variant, or reporting a likelihood that the patient has or will develop such disease.

A causal genetic variant can include sequence variants associated with a particular type or stage of cancer, or of cancer having a particular characteristic such as metastatic potential, drug resistance, and/or drug responsiveness. Methods provided by the present disclosure can be used to inform therapeutic decisions, guidance and monitoring, of cancer therapies. For example, treatment efficacy can be monitored by comparing patient ctDNA samples from before, during, and after treatment with particular including molecular targeted therapies such as monoclonal drugs, chemotherapeutic drugs, radiation protocols, and combinations of any of the foregoing. For example, the ctDNA can be monitored to see if certain mutations increase or decrease, or new mutations appear, after treatment, which can allow a physician to modify a treatment in a much shorter period of time than afforded by methods of monitoring that track patient symptoms. Methods can comprise diagnosing a subject based on the results of polynucleotide sequencing, such as diagnosing the subject with a particular stage or type of cancer associated with a detected sequence variant, or reporting a likelihood that the patient has or will develop such cancer.

For example, for therapies that are specifically targeted to patients on the basis of molecular markers, patients can be tested to find out if certain mutations are present in their tumor, and these mutations can be used to predict response or resistance to the therapy and guide the decision whether to use the therapy. Detecting and monitoring ctDNA during the course of treatment can be useful in guiding treatment selections.

Sequence variants associated with one or more kinds of cancer that may be used for diagnosis, prognosis, or treatment decisions. For example, suitable target sequences of oncological significance include alterations in the TP53 gene, the ALK gene, the KRAS gene, the PIK3CA gene, the BRAF gene, the EGFR gene, and the KIT gene. A target sequence the may be specifically amplified, and/or specifically analyzed for sequence variants may be all or part of a cancer-associated gene.

Methods provided by the present disclosure can be useful in discovering new, rare mutations that are associated with one or more cancer types, stages, or cancer characteristics. For example, in populations of individuals sharing a characteristic under analysis such as a particular disease, type of cancer, and/or stage of cancer, using methods provided by the present disclosure sequence variants can be identified reflecting mutations in particular genes or parts of genes. Identified sequence variants occurring with a statistically significantly greater frequency among the group of individuals sharing the characteristic than in individuals without the characteristic may be assigned a degree of association with that characteristic. The sequence variants or types of sequence variants so identified may then be used in diagnosing or treating individuals discovered to harbor them.

Additional therapeutic applications can include use in non-invasive fetal diagnostics. Fetal DNA can be found in the blood of a pregnant woman. Methods provided by the present disclosure can be used to identify sequence variants in circulating fetal DNA, and thus may be used to diagnose one or more genetic diseases in the fetus, such as those associated with one or more causal genetic variants. Examples of causal genetic variants include trisomies, cystic fibrosis, sickle-cell anemia, and Tay-Saks disease. The mother may provide a control sample and a blood sample to be used for comparison. The control sample may be any suitable tissue, and can then be sequenced to provide a reference sequence. Sequences of cfDNA corresponding to fetal genomic DNA can then be identified as sequence variants relative to the maternal reference. The father may also provide a reference sample to aid in identifying fetal sequences, and sequence variants.

Different therapeutic applications can include detection of exogenous polynucleotides, including from pathogens such as bacteria, viruses, fungi, and microbes, which information may inform a treatment.

VII. Computer Systems

The present disclosure provides computer systems that are programmed to implement one or more methods of the present disclosure. Computer systems of the present disclosure may be used to, regulate, for example, the thermal treatment of the NA molecules as disclosed herein or any subsequent sequencing steps.

Figure 3:
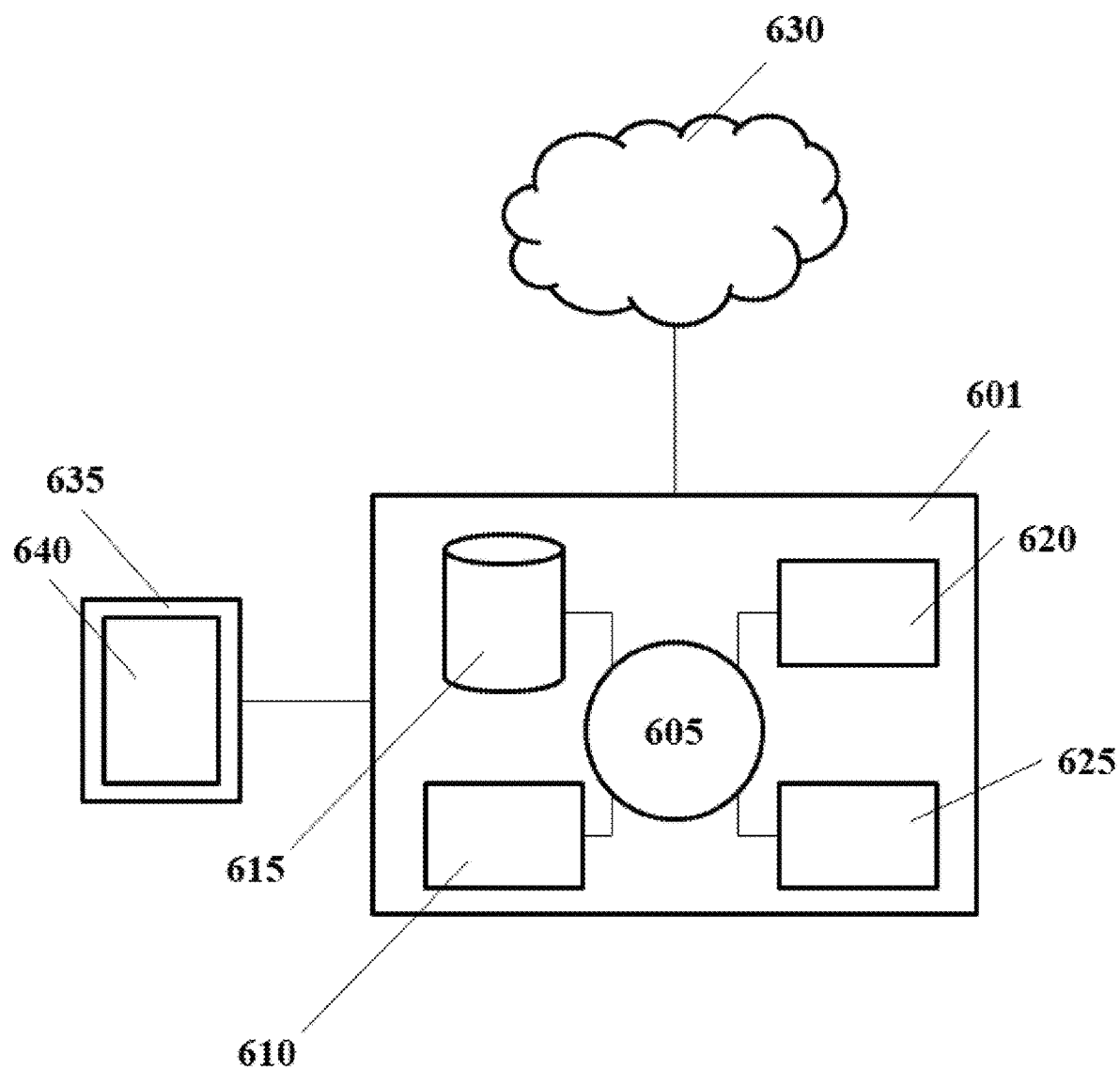
FIG. 3 shows a computer system that is programmed or otherwise configured to implement methods provided herein.

FIG. 3 shows a computer system 601 that is programmed or otherwise configured to communicate with and regulate various aspects of sequencing of the present disclosure. The computer system 601 can communicate with, for example, one or more circuitry coupled to or comprising the sensor, and one or more devices (e.g., machines) used to perform, e.g., the thermal treatment and/or the sequencing. The computer system 601 may also communicate with one or more controllers or processors of the present disclosure. The computer system 601 can be an electronic device of a user or a computer system that is remotely located with respect to the electronic device. The electronic device can be a mobile electronic device.

The computer system 601 includes a central processing unit (CPU, also "processor" and "computer processor" herein) 605, which can be a single core or multi core processor, or a plurality of processors for parallel processing. The computer system 601 also includes memory or memory location 610 (e.g., random-access memory, read-only memory, flash memory), electronic storage unit 615 (e.g., hard disk), communication interface 620 (e.g., network adapter) for communicating with one or more other systems, and peripheral devices 625, such as cache, other memory, data storage and/or electronic display adapters. The memory 610, storage unit 615, interface 620 and peripheral devices 625 are in communication with the CPU 605 through a communication bus (solid lines), such as a motherboard. The storage unit 615 can be a data storage unit (or data repository) for storing data. The computer system 601 can be operatively coupled to a computer network ("network") 630 with the aid of the communication interface 620. The network 630 can be the Internet, an internet and/or extranet, or an intranet and/or extranet that is in communication with the Internet. The network 630 in some cases is a telecommunication and/or data network. The network 630 can include one or more computer servers, which can enable distributed computing, such as cloud computing. The network 630, in some cases with the aid of the computer system 601, can implement a peer-to-peer network, which may enable devices coupled to the computer system 601 to behave as a client or a server.

The CPU 605 can execute a sequence of machine-readable instructions, which can be embodied in a program or software. The instructions may be stored in a memory location, such as the memory 610. The instructions can be directed to the CPU 605, which can subsequently program or otherwise configure the CPU 605 to implement methods of the present disclosure. Examples of operations performed by the CPU 605 can include fetch, decode, execute, and writeback.

The CPU 605 can be part of a circuit, such as an integrated circuit. One or more other components of the system 601 can be included in the circuit. In some cases, the circuit is an application specific integrated circuit (ASIC).

The storage unit 615 can store files, such as drivers, libraries and saved programs. The storage unit 615 can store user data, e.g., user preferences and user programs. The computer system 601 in some cases can include one or more additional data storage units that are external to the computer system 601, such as located on a remote server that is in communication with the computer system 601 through an intranet or the Internet.

The computer system 601 can communicate with one or more remote computer systems through the network 630. For instance, the computer system 601 can communicate with a remote computer system of a user. Examples of remote computer systems include personal computers (e.g., portable PC), slate or tablet PC's (e.g., Apple® iPad, Samsung® Galaxy Tab), telephones, Smart phones (e.g., Apple® iphone, Android-enabled device, Blackberry®), or personal digital assistants. The user can access the computer system 601 via the network 630.

Methods as described herein can be implemented by way of machine (e.g., computer processor) executable code stored on an electronic storage location of the computer system 601, such as, for example, on the memory 610 or electronic storage unit 615. The machine executable or machine readable code can be provided in the form of software. During use, the code can be executed by the processor 605. In some cases, the code can be retrieved from the storage unit 615 and stored on the memory 610 for ready access by the processor 605. In some situations, the electronic storage unit 615 can be precluded, and machine-executable instructions are stored on memory 610.

The code can be pre-compiled and configured for use with a machine having a processer adapted to execute the code, or can be compiled during runtime. The code can be supplied in a programming language that can be selected to enable the code to execute in a pre-compiled or as-compiled fashion.

Aspects of the systems and methods provided herein, such as the computer system 601, can be embodied in programming. Various aspects of the technology may be thought of as "products" or "articles of manufacture" typically in the form of machine (or processor) executable code and/or associated data that is carried on or embodied in a type of machine readable medium. Machine-executable code can be stored on an electronic storage unit, such as memory (e.g., read-only memory, random-access memory, flash memory) or a hard disk. "Storage" type media can include any or all of the tangible memory of the computers, processors or the like, or associated modules thereof, such as various semiconductor memories, tape drives, disk drives and the like, which may provide non-transitory storage at any time for the software programming. All or portions of the software may at times be communicated through the Internet or various other telecommunication networks. Such communications, for example, may enable loading of the software from one computer or processor into another, for example, from a management server or host computer into the computer platform of an application server. Thus, another type of media that may bear the software elements includes optical, electrical and electromagnetic waves, such as used across physical interfaces between local devices, through wired and optical landline networks and over various air-links. The physical elements that carry such waves, such as wired or wireless links, optical links or the like, also may be considered as media bearing the software. As used herein, unless restricted to non-transitory, tangible "storage" media, terms such as computer or machine "readable medium" refer to any medium that participates in providing instructions to a processor for execution.

Hence, a machine readable medium, such as computer-executable code, may take many forms, including but not limited to, a tangible storage medium, a carrier wave medium or physical transmission medium. Non-volatile storage media include, for example, optical or magnetic disks, such as any of the storage devices in any computer(s) or the like, such as may be used to implement the databases, etc. shown in the drawings. Volatile storage media include dynamic memory, such as main memory of such a computer platform. Tangible transmission media include coaxial cables; copper wire and fiber optics, including the wires that comprise a bus within a computer system. Carrier-wave transmission media may take the form of electric or electromagnetic signals, or acoustic or light waves such as those generated during radio frequency (RF) and infrared (IR) data communications. Common forms of computer-readable media therefore include for example: a floppy disk, a flexible disk, hard disk, magnetic tape, any other magnetic medium, a CD-ROM, DVD or DVD-ROM, any other optical medium, punch cards paper tape, any other physical storage medium with patterns of holes, a RAM, a ROM, a PROM and EPROM, a FLASH-EPROM, any other memory chip or cartridge, a carrier wave transporting data or instructions, cables or links transporting such a carrier wave, or any other medium from which a computer may read programming code and/or data. Many of these forms of computer readable media may be involved in carrying one or more sequences of one or more instructions to a processor for execution.

The computer system 601 can include or be in communication with an electronic display 635 that comprises a user interface (UI) 640 for providing, for example, (i) progress of the reaction mixture, (ii) progress of sequencing, and (iii) sequencing information obtained from sequencing. Examples of UI's include, without limitation, a graphical user interface (GUI) and web-based user interface.

Methods and systems of the present disclosure can be implemented by way of one or more algorithms. An algorithm can be implemented by way of software upon execution by the central processing unit 605. The algorithm can, for example, determine sequence readout of a target nucleotide, polynucleotide, peptide, polypeptide, protein, etc.

It shall be understood that different aspects of the invention can be appreciated individually, collectively, or in combination with each other. Various aspects of the invention described herein may be applied to any of the particular applications disclosed herein. The compositions of matter including compounds of any formulae disclosed herein in the composition section of the present disclosure may be utilized in the method section including methods of use and production disclosed herein, or vice versa.

EXAMPLES

Example 1: Selective Circularization of Nucleic Acid Molecules

FIG. 1A schematically illustrates an example of a method for processing a nucleic acid sample. The method may achieve NA preparation (e.g., DNA and/or RNA preparation) for simultaneous sequencing of long reads and high accuracy circular reads. The method may be for a sequencing library construction. The method may generate, simultaneously, (i) linear DNA templates for long sequencing reads and (ii) circular short DNA templates for high-accuracy consensus sequencing (e.g., short sequencing reads). The linear DNA templates may have an average NA size that is bigger than or equal to a size threshold (e.g., 3 kb, 2 kb, or 1 kb). The circular short DNA templates may have an average NA size that is smaller than the size threshold (e.g., 3 kb, 2 kb, or 1 kb).

Figure 1B:
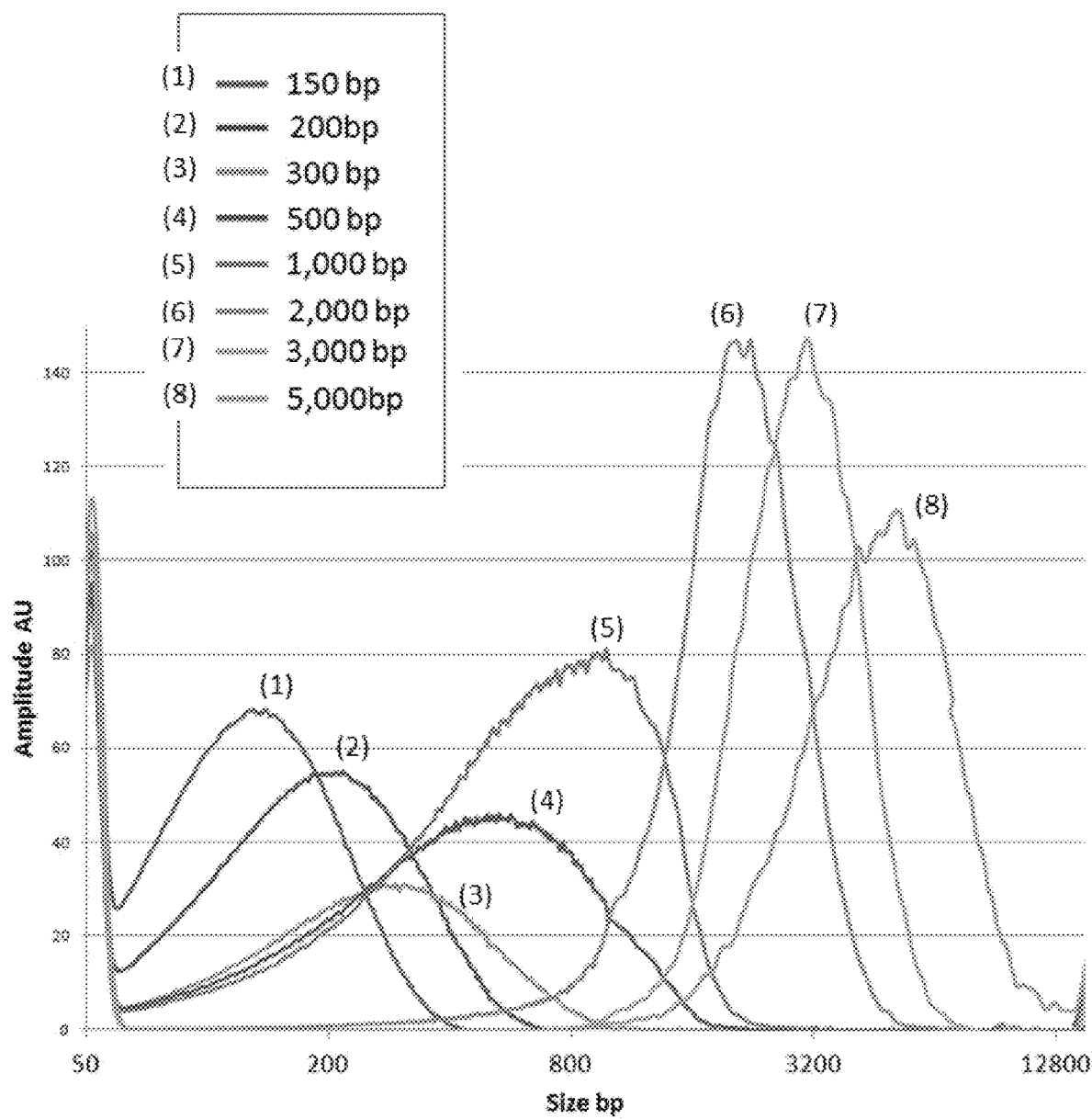
FIG. 1B provides a size distribution of a plurality of nucleic acid molecules in a sample prior to prior to circularization of at least a portion of the plurality of nucleic acid molecules.

Referring to FIG. 1A, the method may comprise (a) shearing DNA in a sample to generate DNA fragments having an average size between about 0.3 kb and about 50 kb; (b) repairing end(s) and/or internal nick(s) in the DNA fragments; (c) performing adenylation (A-tailing) of the blunt end(s) of the DNA fragments; (d) ligating adapter(s) to the DNA fragments, wherein each adapter comprising Uracil(s) in specific locations within the adapter; (e) digesting the Uracil(s) of the adapter(s) ligated to the DNA fragments with one or more enzymes (e.g., a USER enzyme), to create complementary cohesive ends for each of the DNA fragments, thereby generating a reaction mixture; (f) performing dilution of the reaction mixture and, subsequently, subjecting the diluted reaction mixture to heating (e.g., for about 5 minutes) at a temperature of between about 70° C. and about 75° C.; (g) performing time-controlled cooling (e.g., a time-controlled cooling ramp) resulting in substantial or predominant circularization of short DNA fragments (e.g., having an average size/length of less than about 2 kb, or less than about 1 kb), while disfavoring formation of circular molecules and/or concatemers of long DNA fragments (e.g., having an average size/length of greater than about 1 kb, or greater than about 2 kb); and (h) performing ligation reaction to seal a nick in the circularized short DNA fragments/molecules, to yield in double-stranded circular sequencing templates comprising the gap in one of the strands, wherein 3' end of the gap is configured to serve as the priming site for polymerase synthesis. Following, DNA sequencing of the double-stranded circular sequencing templates may be initiated from the gap, e.g., by using a polymerase for sequencing-by-synthesis. DNA sequencing of the uncircularized long DNA templates may be initiated by annealing of primer to the long linear templates. FIG. 1B provides an example size distribution of a plurality of DNA fragments (e.g., double stranded DNA molecules) by shearing and prior to the circularization, as described in FIG. 1A.

Example 2: Circularization of Nucleic Acid Molecules (e.g., Double-Stranded DNA Fragments (dsDNA))

In some cases, circularization of nucleic acid molecules can be controlled by, e.g., length of the nucleic acid molecules, concentration of the nucleic acid molecules in a sample during the circularization, or thermal properties (e.g., cooling rate) of the circularization process.

Effect of dsDNA Fragment Length

Figure 4A:
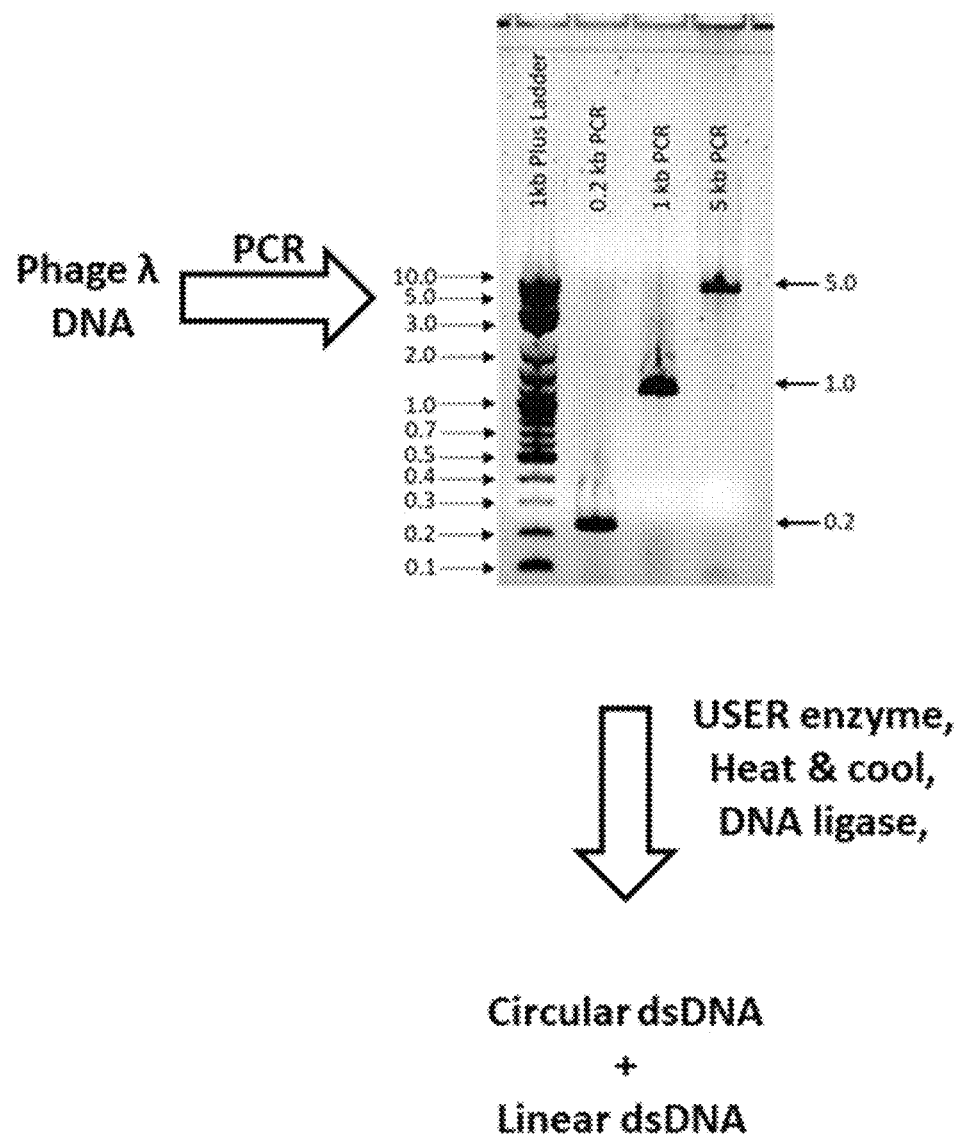
FIGS. 4A-4F show an example of circularization-ligation.

Three dsDNA of various length, i.e., 227 bp (~0.2 kb), 1122 bp (~1 kb), and 4908 bp (~5 kb) were generated by PCR using phage Lambda DNA as a template (FIG. 4A). Forward and Reverse PCR primers, BVI_FWD4900 and BVI_REV200, were used to make 0.2 kb dsDNA fragments (0.2 kb dsDNA). Forward and Reverse PCR primers, BVI_FWD4900 and BVI_REV1000 primers, were deployed to generate 1 kb dsDNA fragments (1 kb dsDNA). Forward and Reverse PCR primers, BVI_FWD4900 and BVI-REV4900, were used to generate 5 kb dsDNA fragments (5 kb dsDNA).

The Forward and Reverse PCR primers were designed with two Uracil residues each in specific positions within the primers. In order to incorporate these Uracil-containing primers into the final PCR product, a special DNA polymerase, Q5U Hot Start High-Fidelity DNA Polymerase (New England Biolabs, USA) which is tolerant to Uracil-containing template, was used under conditions recommended by manufacturer as follows: (1) initial DNA template denaturation at 98° C. for 30 second; (2) amplification for 15-20 cycles with each cycle comprising (a) denaturation step at 98° C. for 15 second, (b) annealing step at 65° C. for 30 second, and (c) extension step at 72° C. for 20 s, 30 s, and 5 min for 0.2 kb dsDNA, 1 kb dsDNA, and 5 kb dsDNA, respectively; (3) final extension at 72° C. for 3 min; and (4) hold at 4° C. 18, 5, and 1.2 pmoles of 0.2, 1, and 5 kb dsDNA, respectively, were generated, as demonstrated by gel electrophoresis results in FIG. 4A.

Uracil residues at the ends of dsDNA fragments were excised using USER Enzyme in 1× SmartCut Buffer (New England Biolabs, USA). The dsDNA concentration in the mixture was kept at 1 nmol/L (nM). Upon heating to 75° C., sticky-ends were generated at the ends of the dsDNA fragments with one strand had a 13 nucleotide (13 nt) sticky end and the other strand had a 14 nt sticky end (FIG. 4B).

Figure 4B:

The temperature of the mixture was maintained at 75° C. for about 10 min and then cooled down to room temperature, e.g., about 25° C., to generate dsDNA Circles (circular dsDNA) or dsDNA Linear concatemers with the 1 nt gap in one strand (non-ligatable) and a nick (ligatable, as it has 3-OH and 5-Phosphate groups) in the other strand (FIG. 4B). Upon cooling to room temperature, T4 DNA ligase was added with a final concentration of 0.6 Units/μl and the ligation was performed for 30 min at room temperature.

Figure 4C:
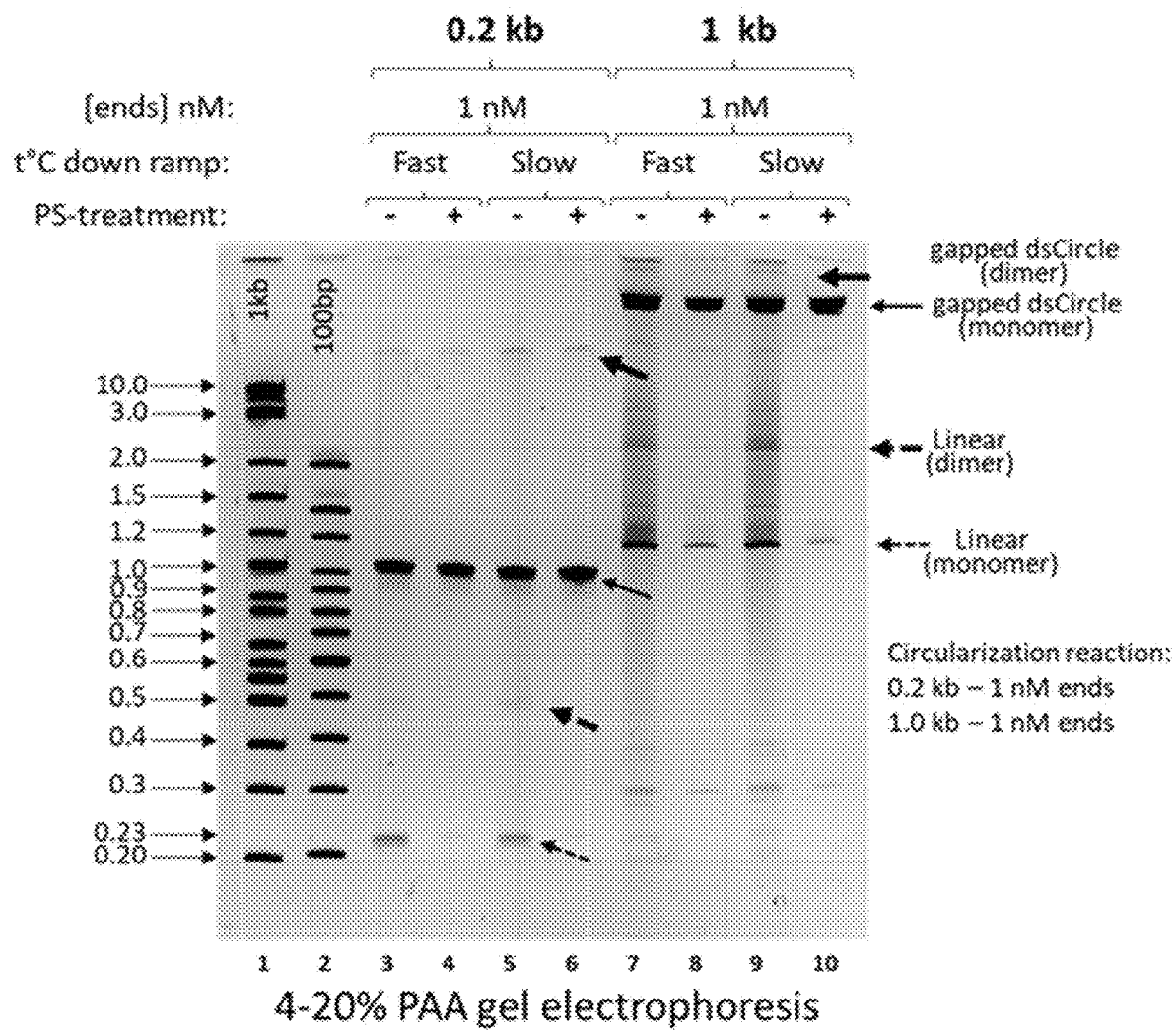
Figure 4D:
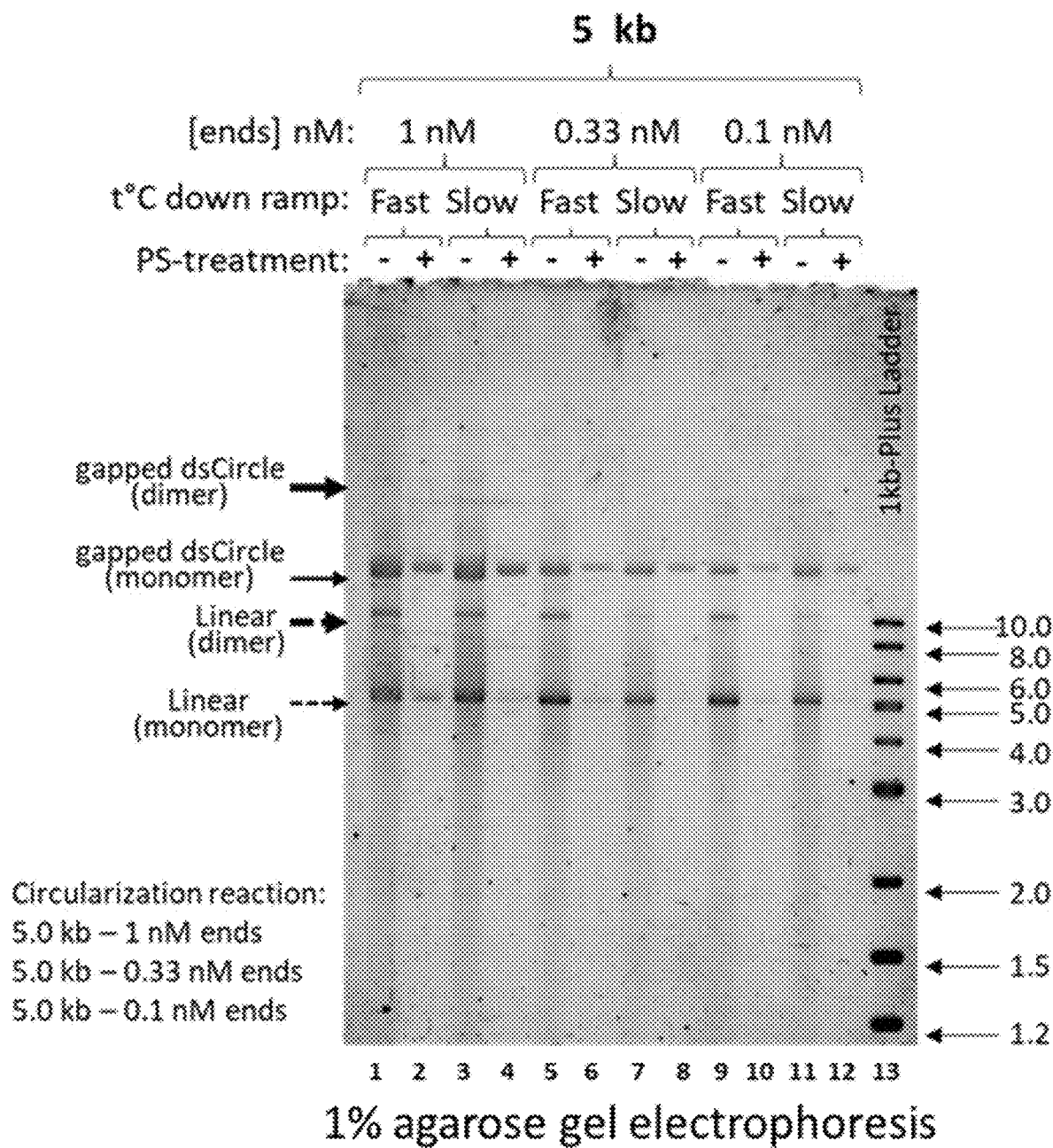

The products of 0.2 kb dsDNA and 1 kb dsDNA circularization-ligation processes were analyzed by 4-20% polyacrylamide gel electrophoresis under non-denaturing conditions (FIG. 4C). The products of 5 kb dsDNA circularization-ligation process were analyzed by 1% agarose gel electrophoresis (FIG. 4D). In these experiments both polyacrylamide and agarose gels were stained with SYBR Green intercalating dye and the bands corresponding to different DNA species were quantified using AzureSpot software. To distinguish between circular and linear products of circularization-ligation process, the samples from each experimental condition were split into two equal aliquots, and one of them was treated with Plasmid-Safe exonuclease (Lucigen, USA), which degrades all linear DNA species, and leaves all circularized DNAs intact.

Figure 4E:
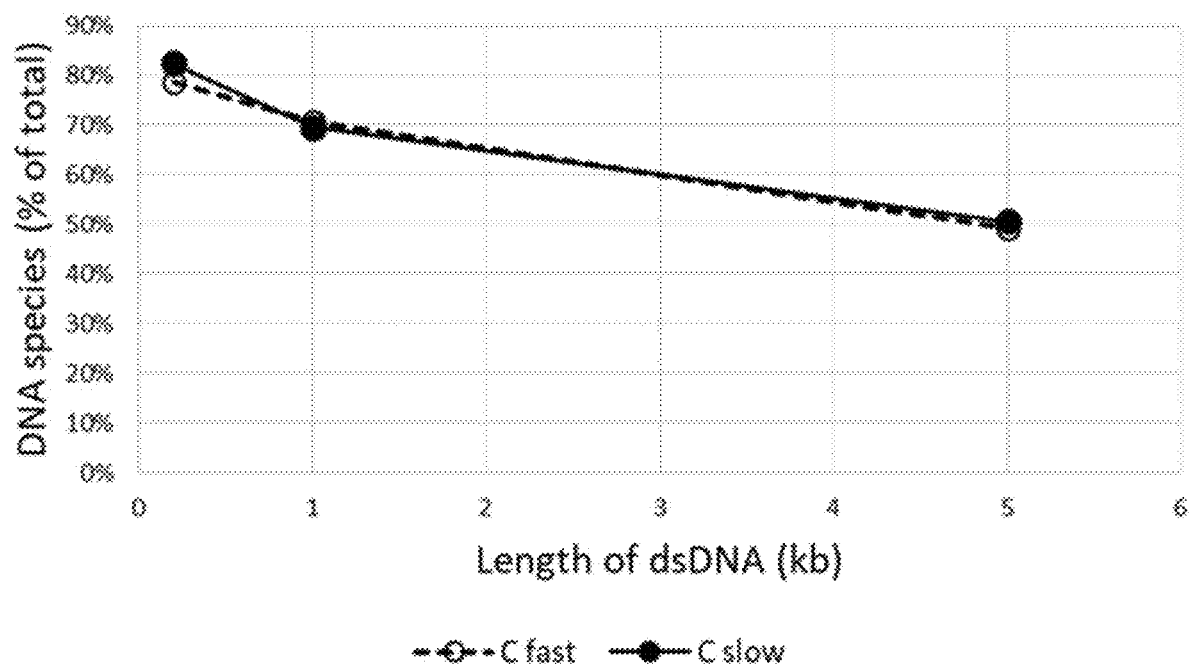

FIG. 4E shows the efficiency of circularization for dsDNA with different lengths (i.e., 0.2 kb DNA, 1 kb DNA, and 5 kb DNA). 0.2 kb DNA exhibited efficient circularization with up to 84% of the DNA molecules were converted to dsDNA Circles in the form of circular monomers and dimers (mostly monomeric Circles). For 1 kb DNA, the number of circularized products dropped by about 10% compared to 0.2 kb DNA, with a circularization efficiency of about 70%. For the 5 kb DNA, the circularization efficiency was the lowest, at about 50%. Shorter (or smaller) DNA molecules have shorter distance between the two sticky ends, resulting in higher probability of circularization.

As demonstrated herein, increasing the length of the nucleic acid molecules (e.g., linear double-stranded DNA) can reduce the rate or efficiency of circularization of the nucleic acid molecules.

Effect of Cooling Rate

Two cooling rates were evaluated in the circularization process of the dsDNA molecules. After heating the USER-treated dsDNA fragments at 75° C. for 10 min, two cooling protocols were tested for each of 0.2, 1, and 5 kb dsDNA samples. The first protocol was the Fast Cooling protocol where temperature was ramped down from 75° C. to 25° C. in about a minute, and the second protocol was the Slow Cooling method where the samples were heated at 75° C. for 10 min in water bath and then, after turning off the bath, slowly cooled to room temperature (in about 1 hour).

Figure 4F:
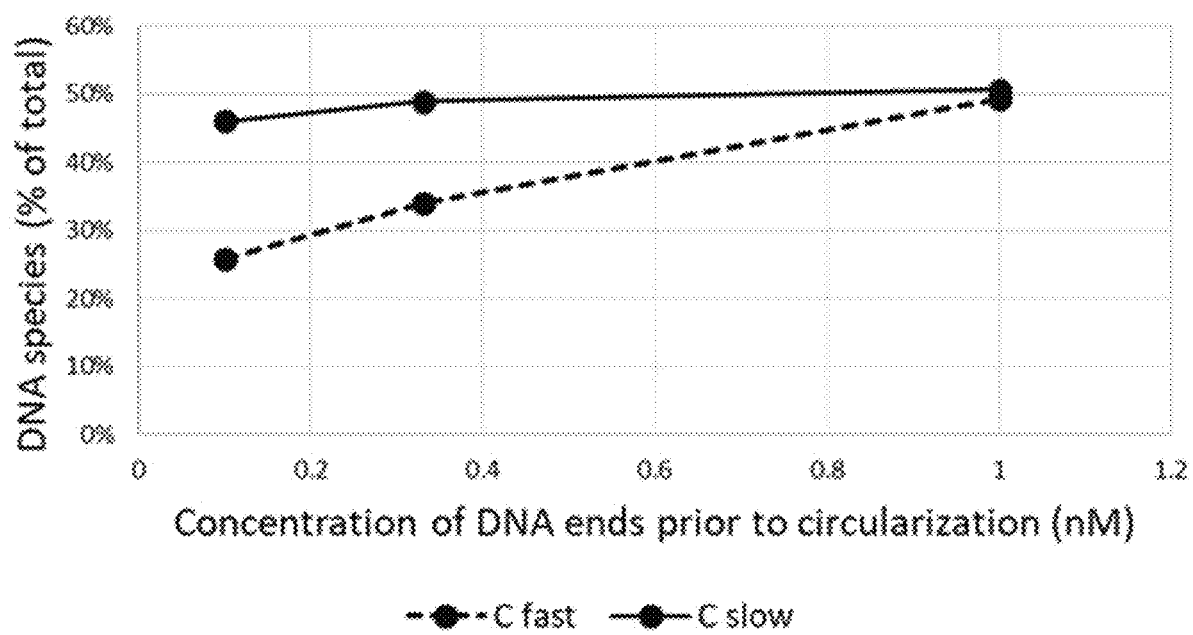

FIG. 4E shows that for all three dsDNA samples at a concentration of 1 nM, i.e., 0.2 kb DNA, 1 kb DNA, and 5 kb DNA, the specific cooling protocols as above mentioned exhibited minimal effect on the circularization efficiency. However, as shown in FIG. 4F, different thermal regulations can affect the circularization efficiency of nucleic acid molecules, to promote selective circularization as disclosed herein. FIG. 4F shows that for 5 kb dsDNA with different concentrations (i.e., 0.1 nM, 0.33 nM, and 1 nM), Fast Cooling resulted in a reduction of circularization efficiency when the dsDNA concentration was lowered. Slow Cooling exhibited a less significant effect on the circularization efficiency for dsDNA with different concentrations.

As demonstrated herein, thermal regulations can promote the selective circularization of nucleic acid molecules (e.g., linear double-stranded DNA).

Effect of dsDNA Concentration

Circularization of 5 kb dsDNA samples at three concentrations, i.e., 1 nM, 0.33 nM, and 0.1 nM was carried out to evaluate the effect of nucleic acid molecules concentration. Both Fast Cooling and Slow Cooling protocols were used for each concentration of 5 kb dsDNA.

With the Fast Cooling protocol (dashed line, FIG. 4F) the circularization efficiency dropped from about 50% to about 33% at 0.33 nM (three-fold dilution) and further down to about 25% at 0.1 nM (ten-fold dilution). However, with Slow Cooling, the number of circular molecules decreased only by about 1% with three-fold dilution and by about 5% with ten-fold dilution (solid line, FIG. 4F). Slow Cooling protocol of circularization was relatively more tolerant to the concentration of the dsDNA.

As demonstrated herein, concentration of the nucleic acid molecules in a sample during the circularization can affect the circularization efficiency of the nucleic acid molecules and can be used to control the selective circularization of nucleic acid molecules.

Example 3: Sequencing Based on Selective Circularization of Nucleic Acid Molecules A sample from selective circularization of nucleic acid molecules (e.g., dsDNA molecules) may comprise a population of circularized nucleic acid molecules and a population of uncircularized, i.e., linear nucleic acid molecules. Those populations of nucleic acid molecules may be used as templates (circularized nucleic acid molecules as circular template and linear nucleic acid molecules as linear template) and be sequenced by at least two different sequencing modalities or a dual-modality sequencing process.

A sequencing primer may be annealed to the linear template, followed by binding DNA polymerase to the linear template, for long read sequencing. Prior to annealing the sequencing primer to the linear template, the concentration of the linear template may be quantified using Qubit HS Assay (ThermoFisher) and the molarity of the linear template solution, which depends on the average linear template length, may be calculated. An optimal primer:linear template molar ratio during annealing may be from about 10:1 to about 20:1. The following steps for annealing of the sequencing primer may be used: (1) heating the primer stock solution with a concentration of 10 μM in TE at 85° C. for 5 min, followed by snap-cooling on ice; (2) mixing an appropriate amount of primer with the equimolar template containing both circular and linear dsDNA molecules in 1× Annealing buffer at a primer:linear template ratio of about 10:1 to 20:1 for about 30 min at room temperature; and (3) storing the sample at 4° C., e.g., in a 4° C. refrigerator for up to 24 hours. Polymerase and buffer containing Mg++ cofactor, additional buffer, dNTPs, etc will be subsequently added to the sample prior to sequencing. Circularized nucleic acid molecules, e.g., circular dsDNA molecules, will not need annealing of the sequencing primer as the DNA polymerase will directly bind to the 1 nt-gap with exposed 3'-ends to initiate sequencing.

While preferred embodiments of the present invention have been shown and described herein, it will be obvious to those skilled in the art that such embodiments are provided by way of example only. It is not intended that the invention be limited by the specific examples provided within the specification. While the invention has been described with reference to the aforementioned specification, the descriptions and illustrations of the embodiments herein are not meant to be construed in a limiting sense. Numerous variations, changes, and substitutions will now occur to those skilled in the art without departing from the invention. Furthermore, it shall be understood that all aspects of the invention are not limited to the specific depictions, configurations or relative proportions set forth herein which depend upon a variety of conditions and variables. It should be understood that various alternatives to the embodiments of the invention described herein may be employed in practicing the invention. It is therefore contemplated that the invention shall also cover any such alternatives, modifications, variations or equivalents. It is intended that the following claims define the scope of the invention and that methods and structures within the scope of these claims and their equivalents be covered thereby.

SEQUENCE LISTING (10 sequences)

SEQ ID NO: 1 - DNA, 1052 bp, synthetic construct
  source 1..1052: mol_type = other DNA
  modified_base 4: mod_base = OTHER; note = Uracil
  modified_base 14: mod_base = OTHER; note = Uracil
  misc_difference 26: note = a, t, c, g, unknown or other
  misc_difference 27: note = a, t, c, g, unknown or other
  misc_difference 28: note = a, t, c, g, unknown or other
  misc_difference 29: note = a, t, c, g, unknown or other
  misc_difference 30: note = a, t, c, g, unknown or other
  misc_difference 31: note = a, t, c, g, unknown or other
  misc_difference 32: note = a, t, c, g, unknown or other
  misc_difference 33: note = a, t, c, g, unknown or other
  misc_difference 34: note = a, t, c, g, unknown or other
  misc_difference 35: note = a, t, c, g, unknown or other
  misc_difference 36: note = a, t, c, g, unknown or other
  misc_difference 37: note = a, t, c, g, unknown or other
  misc_difference 38: note = a, t, c, g, unknown or other
  misc_difference 39: note = a, t, c, g, unknown or other
  misc_difference 40: note = a, t, c, g, unknown or other
  misc_difference 41: note = a, t, c, g, unknown or other
  misc_difference 42: note = a, t, c, g, unknown or other
  misc_difference 43: note = a, t, c, g, unknown or other
  misc_difference 44: note = a, t, c, g, unknown or other
  misc_difference 45: note = a, t, c, g, unknown or other
  misc_difference 46: note = a, t, c, g, unknown or other
  misc_difference 47: note = a, t, c, g, unknown or other
  misc_difference 48: note = a, t, c, g, unknown or other
  misc_difference 49: note = a, t, c, g, unknown or other
  misc_difference 50: note = a, t, c, g, unknown or other
  misc_difference 51: note = a, t, c, g, unknown or other
  misc_difference 52: note = a, t, c, g, unknown or other
  misc_difference 53: note = a, t, c, g, unknown or other
  misc_difference 54: note = a, t, c, g, unknown or other
  misc_difference 55: note = a, t, c, g, unknown or other
  misc_difference 56: note = a, t, c, g, unknown or other
  misc_difference 57: note = a, t, c, g, unknown or other
  misc_difference 58: note = a, t, c, g, unknown or other
  misc_difference 59: note = a, t, c, g, unknown or other
  misc_difference 60: note = a, t, c, g, unknown or other
  misc_difference 61: note = a, t, c, g, unknown or other
  misc_difference 62: note = a, t, c, g, unknown or other
  misc_difference 63: note = a, t, c, g, unknown or other
  misc_difference 64: note = a, t, c, g, unknown or other
  misc_difference 65: note = a, t, c, g, unknown or other
  misc_difference 66: note = a, t, c, g, unknown or other
  misc_difference 67: note = a, t, c, g, unknown or other
  misc_difference 68: note = a, t, c, g, unknown or other
  misc_difference 69: note = a, t, c, g, unknown or other
  misc_difference 70: note = a, t, c, g, unknown or other
  misc_difference 71: note = a, t, c, g, unknown or other
  misc_difference 72: note = a, t, c, g, unknown or other
  misc_difference 73: note = a, t, c, g, unknown or other
  misc_difference 74: note = a, t, c, g, unknown or other
  misc_difference 75: note = a, t, c, g, unknown or other
  misc_difference 76: note = a, t, c, g, unknown or other
  misc_difference 77: note = a, t, c, g, unknown or other
  misc_difference 78: note = a, t, c, g, unknown or other
  misc_difference 79: note = a, t, c, g, unknown or other
  misc_difference 80: note = a, t, c, g, unknown or other
  misc_difference 81: note = a, t, c, g, unknown or other
  misc_difference 82: note = a, t, c, g, unknown or other
  misc_difference 83: note = a, t, c, g, unknown or other
  misc_difference 84: note = a, t, c, g, unknown or other
  misc_difference 85: note = a, t, c, g, unknown or other
  misc_difference 86: note = a, t, c, g, unknown or other
  misc_difference 87: note = a, t, c, g, unknown or other
  misc_difference 88: note = a, t, c, g, unknown or other
  misc_difference 89: note = a, t, c, g, unknown or other
  misc_difference 90: note = a, t, c, g, unknown or other
  misc_difference 91: note = a, t, c, g, unknown or other
  misc_difference 92: note = a, t, c, g, unknown or other
  misc_difference 93: note = a, t, c, g, unknown or other
  misc_difference 94: note = a, t, c, g, unknown or other
  misc_difference 95: note = a, t, c, g, unknown or other
  misc_difference 96: note = a, t, c, g, unknown or other
  misc_difference 97: note = a, t, c, g, unknown or other
  misc_difference 98: note = a, t, c, g, unknown or other
  misc_difference 99: note = a, t, c, g, unknown or other
  misc_difference 100: note = a, t, c, g, unknown or other
  misc_difference 101: note = a, t, c, g, unknown or other
  misc_difference 102: note = a, t, c, g, unknown or other
  misc_difference 103: note = a, t, c, g, unknown or other
  misc_difference 104: note = a, t, c, g, unknown or other
  misc_difference 105: note = a, t, c, g, unknown or other
  misc_difference 106: note = a, t, c, g, unknown or other
  misc_difference 107: note = a, t, c, g, unknown or other
  misc_difference 108: note = a, t, c, g, unknown or other
  misc_difference 109: note = a, t, c, g, unknown or other
  misc_difference 110: note = a, t, c, g, unknown or other
  misc_difference 111: note = a, t, c, g, unknown or other
  misc_difference 112: note = a, t, c, g, unknown or other
  misc_difference 113: note = a, t, c, g, unknown or other
  misc_difference 114: note = a, t, c, g, unknown or other
  misc_difference 115: note = a, t, c, g, unknown or other
  misc_difference 116: note = a, t, c, g, unknown or other
  misc_difference 117: note = a, t, c, g, unknown or other
  misc_difference 118: note = a, t, c, g, unknown or other
  misc_difference 119: note = a, t, c, g, unknown or other
  misc_difference 120: note = a, t, c, g, unknown or other
  misc_difference 121: note = a, t, c, g, unknown or other
  misc_difference 122: note = a, t, c, g, unknown or other
  misc_difference 123: note = a, t, c, g, unknown or other
  misc_difference 124: note = a, t, c, g, unknown or other
  misc_difference 125: note = a, t, c, g, unknown or other
  misc_difference 126: note = a, t, c, g, unknown or other
  misc_difference 127: note = a, t, c, g, unknown or other
  misc_difference 128: note = a, t, c, g, unknown or other
  misc_difference 129: note = a, t, c, g, unknown or other
  misc_difference 130: note = a, t, c, g, unknown or other
  misc_difference 131: note = a, t, c, g, unknown or other
  misc_difference 132: note = a, t, c, g, unknown or other
  misc_difference 133: note = a, t, c, g, unknown or other
  misc_difference 134: note = a, t, c, g, unknown or other
  misc_difference 135: note = a, t, c, g, unknown or other
  misc_difference 136: note = a, t, c, g, unknown or other
  misc_difference 137: note = a, t, c, g, unknown or other
  misc_difference 138: note = a, t, c, g, unknown or other
  misc_difference 139: note = a, t, c, g, unknown or other
  misc_difference 140: note = a, t, c, g, unknown or other
  misc_difference 141: note = a, t, c, g, unknown or other
  misc_difference 142: note = a, t, c, g, unknown or other
  misc_difference 143: note = a, t, c, g, unknown or other
  misc_difference 144: note = a, t, c, g, unknown or other
  misc_difference 145: note = a, t, c, g, unknown or other
  misc_difference 146: note = a, t, c, g, unknown or other
  misc_difference 147: note = a, t, c, g, unknown or other
  misc_difference 148: note = a, t, c, g, unknown or other
  misc_difference 149: note = a, t, c, g, unknown or other
  misc_difference 150: note = a, t, c, g, unknown or other
  misc_difference 151: note = a, t, c, g, unknown or other
  misc_difference 152: note = a, t, c, g, unknown or other
  misc_difference 153: note = a, t, c, g, unknown or other
  misc_difference 154: note = a, t, c, g, unknown or other
  misc_difference 155: note = a, t, c, g, unknown or other
  misc_difference 156: note = a, t, c, g, unknown or other
  misc_difference 157: note = a, t, c, g, unknown or other
  misc_difference 158: note = a, t, c, g, unknown or other
  misc_difference 159: note = a, t, c, g, unknown or other
  misc_difference 160: note = a, t, c, g, unknown or other
  misc_difference 161: note = a, t, c, g, unknown or other
  misc_difference 162: note = a, t, c, g, unknown or other
  misc_difference 163: note = a, t, c, g, unknown or other
  misc_difference 164: note = a, t, c, g, unknown or other
  misc_difference 165: note = a, t, c, g, unknown or other
  misc_difference 166: note = a, t, c, g, unknown or other
  misc_difference 167: note = a, t, c, g, unknown or other
  misc_difference 168: note = a, t, c, g, unknown or other
  misc_difference 169: note = a, t, c, g, unknown or other
  misc_difference 170: note = a, t, c, g, unknown or other
  misc_difference 171: note = a, t, c, g, unknown or other
  misc_difference 172: note = a, t, c, g, unknown or other
  misc_difference 173: note = a, t, c, g, unknown or other
  misc_difference 174: note = a, t, c, g, unknown or other
  misc_difference 175: note = a, t, c, g, unknown or other
  misc_difference 176: note = a, t, c, g, unknown or other
  misc_difference 177: note = a, t, c, g, unknown or other
  misc_difference 178: note = a, t, c, g, unknown or other
  misc_difference 179: note = a, t, c, g, unknown or other
  misc_difference 180: note = a, t, c, g, unknown or other
  misc_difference 181: note = a, t, c, g, unknown or other
  misc_difference 182: note = a, t, c, g, unknown or other
  misc_difference 183: note = a, t, c, g, unknown or other
  misc_difference 184: note = a, t, c, g, unknown or other
  misc_difference 185: note = a, t, c, g, unknown or other
  misc_difference 186: note = a, t, c, g, unknown or other
  misc_difference 187: note = a, t, c, g, unknown or other
  misc_difference 188: note = a, t, c, g, unknown or other
  misc_difference 189: note = a, t, c, g, unknown or other
  misc_difference 190: note = a, t, c, g, unknown or other
  misc_difference 191: note = a, t, c, g, unknown or other
  misc_difference 192: note = a, t, c, g, unknown or other
  misc_difference 193: note = a, t, c, g, unknown or other
  misc_difference 194: note = a, t, c, g, unknown or other
  misc_difference 195: note = a, t, c, g, unknown or other
  misc_difference 196: note = a, t, c, g, unknown or other
  misc_difference 197: note = a, t, c, g, unknown or other
  misc_difference 198: note = a, t, c, g, unknown or other
  misc_difference 199: note = a, t, c, g, unknown or other
  misc_difference 200: note = a, t, c, g, unknown or other
  misc_difference 201: note = a, t, c, g, unknown or other
  misc_difference 202: note = a, t, c, g, unknown or other
  misc_difference 203: note = a, t, c, g, unknown or other
  misc_difference 204: note = a, t, c, g, unknown or other
  misc_difference 205: note = a, t, c, g, unknown or other
  misc_difference 206: note = a, t, c, g, unknown or other
  misc_difference 207: note = a, t, c, g, unknown or other
  misc_difference 208: note = a, t, c, g, unknown or other
  misc_difference 209: note = a, t, c, g, unknown or other
  misc_difference 210: note = a, t, c, g, unknown or other
  misc_difference 211: note = a, t, c, g, unknown or other
  misc_difference 212: note = a, t, c, g, unknown or other
  misc_difference 213: note = a, t, c, g, unknown or other
  misc_difference 214: note = a, t, c, g, unknown or other
  misc_difference 215: note = a, t, c, g, unknown or other
  misc_difference 216: note = a, t, c, g, unknown or other
  misc_difference 217: note = a, t, c, g, unknown or other
  misc_difference 218: note = a, t, c, g, unknown or other
  misc_difference 219: note = a, t, c, g, unknown or other
  misc_difference 220: note = a, t, c, g, unknown or other
  misc_difference 221: note = a, t, c, g, unknown or other
  misc_difference 222: note = a, t, c, g, unknown or other
  misc_difference 223: note = a, t, c, g, unknown or other
  misc_difference 224: note = a, t, c, g, unknown or other
  misc_difference 225: note = a, t, c, g, unknown or other
  misc_difference 226: note = a, t, c, g, unknown or other
  misc_difference 227: note = a, t, c, g, unknown or other
  misc_difference 228: note = a, t, c, g, unknown or other
  misc_difference 229: note = a, t, c, g, unknown or other
  misc_difference 230: note = a, t, c, g, unknown or other
  misc_difference 231: note = a, t, c, g, unknown or other
  misc_difference 232: note = a, t, c, g, unknown or other
  misc_difference 233: note = a, t, c, g, unknown or other
  misc_difference 234: note = a, t, c, g, unknown or other
  misc_difference 235: note = a, t, c, g, unknown or other
  misc_difference 236: note = a, t, c, g, unknown or other
  misc_difference 237: note = a, t, c, g, unknown or other
  misc_difference 238: note = a, t, c, g, unknown or other
  misc_difference 239: note = a, t, c, g, unknown or other
  misc_difference 240: note = a, t, c, g, unknown or other
  misc_difference 241: note = a, t, c, g, unknown or other
  misc_difference 242: note = a, t, c, g, unknown or other
  misc_difference 243: note = a, t, c, g, unknown or other
  misc_difference 244: note = a, t, c, g, unknown or other
  misc_difference 245: note = a, t, c, g, unknown or other
  misc_difference 246: note = a, t, c, g, unknown or other
  misc_difference 247: note = a, t, c, g, unknown or other
  misc_difference 248: note = a, t, c, g, unknown or other
  misc_difference 249: note = a, t, c, g, unknown or other
  misc_difference 250: note = a, t, c, g, unknown or other
  misc_difference 251: note = a, t, c, g, unknown or other
  misc_difference 252: note = a, t, c, g, unknown or other
  misc_difference 253: note = a, t, c, g, unknown or other
  misc_difference 254: note = a, t, c, g, unknown or other
  misc_difference 255: note = a, t, c, g, unknown or other
  misc_difference 256: note = a, t, c, g, unknown or other
  misc_difference 257: note = a, t, c, g, unknown or other
  misc_difference 258: note = a, t, c, g, unknown or other
  misc_difference 259: note = a, t, c, g, unknown or other
  misc_difference 260: note = a, t, c, g, unknown or other
  misc_difference 261: note = a, t, c, g, unknown or other
  misc_difference 262: note = a, t, c, g, unknown or other
  misc_difference 263: note = a, t, c, g, unknown or other
  misc_difference 264: note = a, t, c, g, unknown or other
  misc_difference 265: note = a, t, c, g, unknown or other
  misc_difference 266: note = a, t, c, g, unknown or other
  misc_difference 267: note = a, t, c, g, unknown or other
  misc_difference 268: note = a, t, c, g, unknown or other
  misc_difference 269: note = a, t, c, g, unknown or other
  misc_difference 270: note = a, t, c, g, unknown or other
  misc_difference 271: note = a, t, c, g, unknown or other
  misc_difference 272: note = a, t, c, g, unknown or other
  misc_difference 273: note = a, t, c, g, unknown or other
  misc_difference 274: note = a, t, c, g, unknown or other
  misc_difference 275: note = a, t, c, g, unknown or other
  misc_difference 276: note = a, t, c, g, unknown or other
  misc_difference 277: note = a, t, c, g, unknown or other
  misc_difference 278: note = a, t, c, g, unknown or other
  misc_difference 279: note = a, t, c, g, unknown or other
  misc_difference 280: note = a, t, c, g, unknown or other
  misc_difference 281: note = a, t, c, g, unknown or other
  misc_difference 282: note = a, t, c, g, unknown or other
  misc_difference 283: note = a, t, c, g, unknown or other
  misc_difference 284: note = a, t, c, g, unknown or other
  misc_difference 285: note = a, t, c, g, unknown or other
  misc_difference 286: note = a, t, c, g, unknown or other
  misc_difference 287: note = a, t, c, g, unknown or other
  misc_difference 288: note = a, t, c, g, unknown or other
  misc_difference 289: note = a, t, c, g, unknown or other
  misc_difference 290: note = a, t, c, g, unknown or other
  misc_difference 291: note = a, t, c, g, unknown or other
  misc_difference 292: note = a, t, c, g, unknown or other
  misc_difference 293: note = a, t, c, g, unknown or other
  misc_difference 294: note = a, t, c, g, unknown or other
  misc_difference 295: note = a, t, c, g, unknown or other
  misc_difference 296: note = a, t, c, g, unknown or other
  misc_difference 297: note = a, t, c, g, unknown or other
  misc_difference 298: note = a, t, c, g, unknown or other
  misc_difference 299: note = a, t, c, g, unknown or other
  misc_difference 300: note = a, t, c, g, unknown or other
  misc_difference 301: note = a, t, c, g, unknown or other
  misc_difference 302: note = a, t, c, g, unknown or other
  misc_difference 303: note = a, t, c, g, unknown or other
  misc_difference 304: note = a, t, c, g, unknown or other
  misc_difference 305: note = a, t, c, g, unknown or other
  misc_difference 306: note = a, t, c, g, unknown or other
  misc_difference 307: note = a, t, c, g, unknown or other
  misc_difference 308: note = a, t, c, g, unknown or other
  misc_difference 309: note = a, t, c, g, unknown or other
  misc_difference 310: note = a, t, c, g, unknown or other
  misc_difference 311: note = a, t, c, g, unknown or other
  misc_difference 312: note = a, t, c, g, unknown or other
  misc_difference 313: note = a, t, c, g, unknown or other
  misc_difference 314: note = a, t, c, g, unknown or other
  misc_difference 315: note = a, t, c, g, unknown or other
  misc_difference 316: note = a, t, c, g, unknown or other
  misc_difference 317: note = a, t, c, g, unknown or other
  misc_difference 318: note = a, t, c, g, unknown or other
  misc_difference 319: note = a, t, c, g, unknown or other
  misc_difference 320: note = a, t, c, g, unknown or other
  misc_difference 321: note = a, t, c, g, unknown or other
  misc_difference 322: note = a, t, c, g, unknown or other
  misc_difference 323: note = a, t, c, g, unknown or other
  misc_difference 324: note = a, t, c, g, unknown or other
  misc_difference 325: note = a, t, c, g, unknown or other
  misc_difference 326: note = a, t, c, g, unknown or other
  misc_difference 327: note = a, t, c, g, unknown or other
  misc_difference 328: note = a, t, c, g, unknown or other
  misc_difference 329: note = a, t, c, g, unknown or other
  misc_difference 330: note = a, t, c, g, unknown or other
  misc_difference 331: note = a, t, c, g, unknown or other
  misc_difference 332: note = a, t, c, g, unknown or other
  misc_difference 333: note = a, t, c, g, unknown or other
  misc_difference 334: note = a, t, c, g, unknown or other
  misc_difference 335: note = a, t, c, g, unknown or other
  misc_difference 336: note = a, t, c, g, unknown or other
  misc_difference 337: note = a, t, c, g, unknown or other
  misc_difference 338: note = a, t, c, g, unknown or other
  misc_difference 339: note = a, t, c, g, unknown or other
  misc_difference 340: note = a, t, c, g, unknown or other
  misc_difference 341: note = a, t, c, g, unknown or other
  misc_difference 342: note = a, t, c, g, unknown or other
  misc_difference 343: note = a, t, c, g, unknown or other
  misc_difference 344: note = a, t, c, g, unknown or other
  misc_difference 345: note = a, t, c, g, unknown or other
  misc_difference 346: note = a, t, c, g, unknown or other
  misc_difference 347: note = a, t, c, g, unknown or other
  misc_difference 348: note = a, t, c, g, unknown or other
  misc_difference 349: note = a, t, c, g, unknown or other
  misc_difference 350: note = a, t, c, g, unknown or other
  misc_difference 351: note = a, t, c, g, unknown or other
  misc_difference 352: note = a, t, c, g, unknown or other
  misc_difference 353: note = a, t, c, g, unknown or other
  misc_difference 354: note = a, t, c, g, unknown or other
  misc_difference 355: note = a, t, c, g, unknown or other
  misc_difference 356: note = a, t, c, g, unknown or other
  misc_difference 357: note = a, t, c, g, unknown or other
  misc_difference 358: note = a, t, c, g, unknown or other
  misc_difference 359: note = a, t, c, g, unknown or other
  misc_difference 360: note = a, t, c, g, unknown or other
  misc_difference 361: note = a, t, c, g, unknown or other
  misc_difference 362: note = a, t, c, g, unknown or other
  misc_difference 363: note = a, t, c, g, unknown or other
  misc_difference 364: note = a, t, c, g, unknown or other
  misc_difference 365: note = a, t, c, g, unknown or other
  misc_difference 366: note = a, t, c, g, unknown or other
  misc_difference 367: note = a, t, c, g, unknown or other
  misc_difference 368: note = a, t, c, g, unknown or other
  misc_difference 369: note = a, t, c, g, unknown or other
  misc_difference 370: note = a, t, c, g, unknown or other
  misc_difference 371: note = a, t, c, g, unknown or other
  misc_difference 372: note = a, t, c, g, unknown or other
  misc_difference 373: note = a, t, c, g, unknown or other
  misc_difference 374: note = a, t, c, g, unknown or other
  misc_difference 375: note = a, t, c, g, unknown or other
  misc_difference 376: note = a, t, c, g, unknown or other
  misc_difference 377: note = a, t, c, g, unknown or other
  misc_difference 378: note = a, t, c, g, unknown or other
  misc_difference 379: note = a, t, c, g, unknown or other
  misc_difference 380: note = a, t, c, g, unknown or other
  misc_difference 381: note = a, t, c, g, unknown or other
  misc_difference 382: note = a, t, c, g, unknown or other
  misc_difference 383: note = a, t, c, g, unknown or other
  misc_difference 384: note = a, t, c, g, unknown or other
  misc_difference 385: note = a, t, c, g, unknown or other
  misc_difference 386: note = a, t, c, g, unknown or other
  misc_difference 387: note = a, t, c, g, unknown or other
  misc_difference 388: note = a, t, c, g, unknown or other
  misc_difference 389: note = a, t, c, g, unknown or other
  misc_difference 390: note = a, t, c, g, unknown or other
  misc_difference 391: note = a, t, c, g, unknown or other
  misc_difference 392: note = a, t, c, g, unknown or other
  misc_difference 393: note = a, t, c, g, unknown or other
  misc_difference 394: note = a, t, c, g, unknown or other
  misc_difference 395: note = a, t, c, g, unknown or other
  misc_difference 396: note = a, t, c, g, unknown or other
  misc_difference 397: note = a, t, c, g, unknown or other
  misc_difference 398: note = a, t, c, g, unknown or other
  misc_difference 399: note = a, t, c, g, unknown or other
  misc_difference 400: note = a, t, c, g, unknown or other
  misc_difference 401: note = a, t, c, g, unknown or other
  misc_difference 402: note = a, t, c, g, unknown or other
  misc_difference 403: note = a, t, c, g, unknown or other
  misc_difference 404: note = a, t, c, g, unknown or other
  misc_difference 405: note = a, t, c, g, unknown or other
  misc_difference 406: note = a, t, c, g, unknown or other
  misc_difference 407: note = a, t, c, g, unknown or other
  misc_difference 408: note = a, t, c, g, unknown or other
  misc_difference 409: note = a, t, c, g, unknown or other
  misc_difference 410: note = a, t, c, g, unknown or other
  misc_difference 411: note = a, t, c, g, unknown or other
  misc_difference 412: note = a, t, c, g, unknown or other
  misc_difference 413: note = a, t, c, g, unknown or other
  misc_difference 414: note = a, t, c, g, unknown or other
  misc_difference 415: note = a, t, c, g, unknown or other
  misc_difference 416: note = a, t, c, g, unknown or other
  misc_difference 417: note = a, t, c, g, unknown or other
  misc_difference 418: note = a, t, c, g, unknown or other
  misc_difference 419: note = a, t, c, g, unknown or other
  misc_difference 420: note = a, t, c, g, unknown or other
  misc_difference 421: note = a, t, c, g, unknown or other
  misc_difference 422: note = a, t, c, g, unknown or other
  misc_difference 423: note = a, t, c, g, unknown or other
  misc_difference 424: note = a, t, c, g, unknown or other
  misc_difference 425: note = a, t, c, g, unknown or other
  misc_difference 426: note = a, t, c, g, unknown or other
  misc_difference 427: note = a, t, c, g, unknown or other
  misc_difference 428: note = a, t, c, g, unknown or other
  misc_difference 429: note = a, t, c, g, unknown or other
  misc_difference 430: note = a, t, c, g, unknown or other
  misc_difference 431: note = a, t, c, g, unknown or other
  misc_difference 432: note = a, t, c, g, unknown or other
  misc_difference 433: note = a, t, c, g, unknown or other
  misc_difference 434: note = a, t, c, g, unknown or other
  misc_difference 435: note = a, t, c, g, unknown or other
  misc_difference 436: note = a, t, c, g, unknown or other
  misc_difference 437: note = a, t, c, g, unknown or other
  misc_difference 438: note = a, t, c, g, unknown or other
  misc_difference 439: note = a, t, c, g, unknown or other
  misc_difference 440: note = a, t, c, g, unknown or other
  misc_difference 441: note = a, t, c, g, unknown or other
  misc_difference 442: note = a, t, c, g, unknown or other
  misc_difference 443: note = a, t, c, g, unknown or other
  misc_difference 444: note = a, t, c, g, unknown or other
  misc_difference 445: note = a, t, c, g, unknown or other
  misc_difference 446: note = a, t, c, g, unknown or other
  misc_difference 447: note = a, t, c, g, unknown or other
  misc_difference 448: note = a, t, c, g, unknown or other
  misc_difference 449: note = a, t, c, g, unknown or other
  misc_difference 450: note = a, t, c, g, unknown or other
  misc_difference 451: note = a, t, c, g, unknown or other
  misc_difference 452: note = a, t, c, g, unknown or other
  misc_difference 453: note = a, t, c, g, unknown or other
  misc_difference 454: note = a, t, c, g, unknown or other
  misc_difference 455: note = a, t, c, g, unknown or other
  misc_difference 456: note = a, t, c, g, unknown or other
  misc_difference 457: note = a, t, c, g, unknown or other
  misc_difference 458: note = a, t, c, g, unknown or other
  misc_difference 459: note = a, t, c, g, unknown or other
  misc_difference 460: note = a, t, c, g, unknown or other
  misc_difference 461: note = a, t, c, g, unknown or other
  misc_difference 462: note = a, t, c, g, unknown or other
  misc_difference 463: note = a, t, c, g, unknown or other
  misc_difference 464: note = a, t, c, g, unknown or other
  misc_difference 465: note = a, t, c, g, unknown or other
  misc_difference 466: note = a, t, c, g, unknown or other
  misc_difference 467: note = a, t, c, g, unknown or other
  misc_difference 468: note = a, t, c, g, unknown or other
  misc_difference 469: note = a, t, c, g, unknown or other
  misc_difference 470: note = a, t, c, g, unknown or other
  misc_difference 471: note = a, t, c, g, unknown or other
  misc_difference 472: note = a, t, c, g, unknown or other
  misc_difference 473: note = a, t, c, g, unknown or other
  misc_difference 474: note = a, t, c, g, unknown or other
  misc_difference 475: note = a, t, c, g, unknown or other
  misc_difference 476: note = a, t, c, g, unknown or other
  misc_difference 477: note = a, t, c, g, unknown or other
  misc_difference 478: note = a, t, c, g, unknown or other
  misc_difference 479: note = a, t, c, g, unknown or other
  misc_difference 480: note = a, t, c, g, unknown or other
  misc_difference 481: note = a, t, c, g, unknown or other
  misc_difference 482: note = a, t, c, g, unknown or other
  misc_difference 483: note = a, t, c, g, unknown or other
  misc_difference 484: note = a, t, c, g, unknown or other
  misc_difference 485: note = a, t, c, g, unknown or other
  misc_difference 486: note = a, t, c, g, unknown or other
  misc_difference 487: note = a, t, c, g, unknown or other
  misc_difference 488: note = a, t, c, g, unknown or other
  misc_difference 489: note = a, t, c, g, unknown or other
  misc_difference 490: note = a, t, c, g, unknown or other
  misc_difference 491: note = a, t, c, g, unknown or other
  misc_difference 492: note = a, t, c, g, unknown or other
  misc_difference 493: note = a, t, c, g, unknown or other
  misc_difference 494: note = a, t, c, g, unknown or other
  misc_difference 495: note = a, t, c, g, unknown or other
  misc_difference 496: note = a, t, c, g, unknown or other
  misc_difference 497: note = a, t, c, g, unknown or other
  misc_difference 498: note = a, t, c, g, unknown or other
  misc_difference 499: note = a, t, c, g, unknown or other
  misc_difference 500: note = a, t, c, g, unknown or other
  misc_difference 501: note = a, t, c, g, unknown or other
  misc_difference 502: note = a, t, c, g, unknown or other
  misc_difference 503: note = a, t, c, g, unknown or other
  misc_difference 504: note = a, t, c, g, unknown or other
  misc_difference 505: note = a, t, c, g, unknown or other
  misc_difference 506: note = a, t, c, g, unknown or other
  misc_difference 507: note = a, t, c, g, unknown or other
  misc_difference 508: note = a, t, c, g, unknown or other
  misc_difference 509: note = a, t, c, g, unknown or other
  misc_difference 510: note = a, t, c, g, unknown or other
  misc_difference 511: note = a, t, c, g, unknown or other
  misc_difference 512: note = a, t, c, g, unknown or other
  misc_difference 513: note = a, t, c, g, unknown or other
  misc_difference 514: note = a, t, c, g, unknown or other
  misc_difference 515: note = a, t, c, g, unknown or other
  misc_difference 516: note = a, t, c, g, unknown or other
  misc_difference 517: note = a, t, c, g, unknown or other
  misc_difference 518: note = a, t, c, g, unknown or other
  misc_difference 519: note = a, t, c, g, unknown or other
  misc_difference 520: note = a, t, c, g, unknown or other
  misc_difference 521: note = a, t, c, g, unknown or other
  misc_difference 522: note = a, t, c, g, unknown or other
  misc_difference 523: note = a, t, c, g, unknown or other
  misc_difference 524: note = a, t, c, g, unknown or other
  misc_difference 525: note = a, t, c, g, unknown or other
  misc_difference 526: note = a, t, c, g, unknown or other
  misc_difference 527: note = a, t, c, g, unknown or other
  misc_difference 528: note = a, t, c, g, unknown or other
  misc_difference 529: note = a, t, c, g, unknown or other
  misc_difference 530: note = a, t, c, g, unknown or other
  misc_difference 531: note = a, t, c, g, unknown or other
  misc_difference 532: note = a, t, c, g, unknown or other
  misc_difference 533: note = a, t, c, g, unknown or other
  misc_difference 534: note = a, t, c, g, unknown or other
  misc_difference 535: note = a, t, c, g, unknown or other
  misc_difference 536: note = a, t, c, g, unknown or other
  misc_difference 537: note = a, t, c, g, unknown or other
  misc_difference 538: note = a, t, c, g, unknown or other
  misc_difference 539: note = a, t, c, g, unknown or other
  misc_difference 540: note = a, t, c, g, unknown or other
  misc_difference 541: note = a, t, c, g, unknown or other
  misc_difference 542: note = a, t, c, g, unknown or other
  misc_difference 543: note = a, t, c, g, unknown or other
  misc_difference 544: note = a, t, c, g, unknown or other
  misc_difference 545: note = a, t, c, g, unknown or other
  misc_difference 546: note = a, t, c, g, unknown or other
  misc_difference 547: note = a, t, c, g, unknown or other
  misc_difference 548: note = a, t, c, g, unknown or other
  misc_difference 549: note = a, t, c, g, unknown or other
  misc_difference 550: note = a, t, c, g, unknown or other
  misc_difference 551: note = a, t, c, g, unknown or other
  misc_difference 552: note = a, t, c, g, unknown or other
  misc_difference 553: note = a, t, c, g, unknown or other
  misc_difference 554: note = a, t, c, g, unknown or other
  misc_difference 555: note = a, t, c, g, unknown or other
  misc_difference 556: note = a, t, c, g, unknown or other
  misc_difference 557: note = a, t, c, g, unknown or other
  misc_difference 558: note = a, t, c, g, unknown or other
  misc_difference 559: note = a, t, c, g, unknown or other
  misc_difference 560: note = a, t, c, g, unknown or other
  misc_difference 561: note = a, t, c, g, unknown or other
  misc_difference 562: note = a, t, c, g, unknown or other
  misc_difference 563: note = a, t, c, g, unknown or other
  misc_difference 564: note = a, t, c, g, unknown or other
  misc_difference 565: note = a, t, c, g, unknown or other
  misc_difference 566: note = a, t, c, g, unknown or other
  misc_difference 567: note = a, t, c, g, unknown or other
  misc_difference 568: note = a, t, c, g, unknown or other
  misc_difference 569: note = a, t, c, g, unknown or other
  misc_difference 570: note = a, t, c, g, unknown or other
  misc_difference 571: note = a, t, c, g, unknown or other
  misc_difference 572: note = a, t, c, g, unknown or other
  misc_difference 573: note = a, t, c, g, unknown or other
  misc_difference 574: note = a, t, c, g, unknown or other
  misc_difference 575: note = a, t, c, g, unknown or other
  misc_difference 576: note = a, t, c, g, unknown or other
  misc_difference 577: note = a, t, c, g, unknown or other
  misc_difference 578: note = a, t, c, g, unknown or other
  misc_difference 579: note = a, t, c, g, unknown or other
  misc_difference 580: note = a, t, c, g, unknown or other
  misc_difference 581: note = a, t, c, g, unknown or other
  misc_difference 582: note = a, t, c, g, unknown or other
  misc_difference 583: note = a, t, c, g, unknown or other
  misc_difference 584: note = a, t, c, g, unknown or other
  misc_difference 585: note = a, t, c, g, unknown or other
  misc_difference 586: note = a, t, c, g, unknown or other
  misc_difference 587: note = a, t, c, g, unknown or other
  misc_difference 588: note = a, t, c, g, unknown or other
  misc_difference 589: note = a, t, c, g, unknown or other
  misc_difference 590: note = a, t, c, g, unknown or other
  misc_difference 591: note = a, t, c, g, unknown or other
  misc_difference 592: note = a, t, c, g, unknown or other
  misc_difference 593: note = a, t, c, g, unknown or other
  misc_difference 594: note = a, t, c, g, unknown or other
  misc_difference 595: note = a, t, c, g, unknown or other
  misc_difference 596: note = a, t, c, g, unknown or other
  misc_difference 597: note = a, t, c, g, unknown or other
  misc_difference 598: note = a, t, c, g, unknown or other
  misc_difference 599: note = a, t, c, g, unknown or other
  misc_difference 600: note = a, t, c, g, unknown or other
  misc_difference 601: note = a, t, c, g, unknown or other
  misc_difference 602: note = a, t, c, g, unknown or other
  misc_difference 603: note = a, t, c, g, unknown or other
  misc_difference 604: note = a, t, c, g, unknown or other
  misc_difference 605: note = a, t, c, g, unknown or other
  misc_difference 606: note = a, t, c, g, unknown or other
  misc_difference 607: note = a, t, c, g, unknown or other
  misc_difference 608: note = a, t, c, g, unknown or other
  misc_difference 609: note = a, t, c, g, unknown or other
  misc_difference 610: note = a, t, c, g, unknown or other
  misc_difference 611: note = a, t, c, g, unknown or other
  misc_difference 612: note = a, t, c, g, unknown or other
  misc_difference 613: note = a, t, c, g, unknown or other
  misc_difference 614: note = a, t, c, g, unknown or other
  misc_difference 615: note = a, t, c, g, unknown or other
  misc_difference 616: note = a, t, c, g, unknown or other
  misc_difference 617: note = a, t, c, g, unknown or other
  misc_difference 618: note = a, t, c, g, unknown or other
  misc_difference 619: note = a, t, c, g, unknown or other
  misc_difference 620: note = a, t, c, g, unknown or other
  misc_difference 621: note = a, t, c, g, unknown or other
  misc_difference 622: note = a, t, c, g, unknown or other
  misc_difference 623: note = a, t, c, g, unknown or other
  misc_difference 624: note = a, t, c, g, unknown or other
  misc_difference 625: note = a, t, c, g, unknown or other
  misc_difference 626: note = a, t, c, g, unknown or other
  misc_difference 627: note = a, t, c, g, unknown or other
  misc_difference 628: note = a, t, c, g, unknown or other
  misc_difference 629: note = a, t, c, g, unknown or other
  misc_difference 630: note = a, t, c, g, unknown or other
  misc_difference 631: note = a, t, c, g, unknown or other
  misc_difference 632: note = a, t, c, g, unknown or other
  misc_difference 633: note = a, t, c, g, unknown or other
  misc_difference 634: note = a, t, c, g, unknown or other
  misc_difference 635: note = a, t, c, g, unknown or other
  misc_difference 636: note = a, t, c, g, unknown or other
  misc_difference 637: note = a, t, c, g, unknown or other
  misc_difference 638: note = a, t, c, g, unknown or other
  misc_difference 639: note = a, t, c, g, unknown or other
  misc_difference 640: note = a, t, c, g, unknown or other
  misc_difference 641: note = a, t, c, g, unknown or other
  misc_difference 642: note = a, t, c, g, unknown or other
  misc_difference 643: note = a, t, c, g, unknown or other
  misc_difference 644: note = a, t, c, g, unknown or other
  misc_difference 645: note = a, t, c, g, unknown or other
  misc_difference 646: note = a, t, c, g, unknown or other
  misc_difference 647: note = a, t, c, g, unknown or other
  misc_difference 648: note = a, t, c, g, unknown or other
  misc_difference 649: note = a, t, c, g, unknown or other
  misc_difference 650: note = a, t, c, g, unknown or other
  misc_difference 651: note = a, t, c, g, unknown or other
  misc_difference 652: note = a, t, c, g, unknown or other
  misc_difference 653: note = a, t, c, g, unknown or other
  misc_difference 654: note = a, t, c, g, unknown or other
  misc_difference 655: note = a, t, c, g, unknown or other
  misc_difference 656: note = a, t, c, g, unknown or other
  misc_difference 657: note = a, t, c, g, unknown or other
  misc_difference 658: note = a, t, c, g, unknown or other
  misc_difference 659: note = a, t, c, g, unknown or other
  misc_difference 660: note = a, t, c, g, unknown or other
  misc_difference 661: note = a, t, c, g, unknown or other
  misc_difference 662: note = a, t, c, g, unknown or other
  misc_difference 663: note = a, t, c, g, unknown or other
  misc_difference 664: note = a, t, c, g, unknown or other
  misc_difference 665: note = a, t, c, g, unknown or other
  misc_difference 666: note = a, t, c, g, unknown or other
  misc_difference 667: note = a, t, c, g, unknown or other
  misc_difference 668: note = a, t, c, g, unknown or other
  misc_difference 669: note = a, t, c, g, unknown or other
  misc_difference 670: note = a, t, c, g, unknown or other
  misc_difference 671: note = a, t, c, g, unknown or other
  misc_difference 672: note = a, t, c, g, unknown or other
  misc_difference 673: note = a, t, c, g, unknown or other
  misc_difference 674: note = a, t, c, g, unknown or other
  misc_difference 675: note = a, t, c, g, unknown or other
  misc_difference 676: note = a, t, c, g, unknown or other
  misc_difference 677: note = a, t, c, g, unknown or other
  misc_difference 678: note = a, t, c, g, unknown or other
  misc_difference 679: note = a, t, c, g, unknown or other
  misc_difference 680: note = a, t, c, g, unknown or other
  misc_difference 681: note = a, t, c, g, unknown or other
  misc_difference 682: note = a, t, c, g, unknown or other
  misc_difference 683: note = a, t, c, g, unknown or other
  misc_difference 684: note = a, t, c, g, unknown or other
  misc_difference 685: note = a, t, c, g, unknown or other
  misc_difference 686: note = a, t, c, g, unknown or other
  misc_difference 687: note = a, t, c, g, unknown or other
  misc_difference 688: note = a, t, c, g, unknown or other
  misc_difference 689: note = a, t, c, g, unknown or other
  misc_difference 690: note = a, t, c, g, unknown or other
  misc_difference 691: note = a, t, c, g, unknown or other
  misc_difference 692: note = a, t, c, g, unknown or other
  misc_difference 693: note = a, t, c, g, unknown or other
  misc_difference 694: note = a, t, c, g, unknown or other
  misc_difference 695: note = a, t, c, g, unknown or other
  misc_difference 696: note = a, t, c, g, unknown or other
  misc_difference 697: note = a, t, c, g, unknown or other
  misc_difference 698: note = a, t, c, g, unknown or other
  misc_difference 699: note = a, t, c, g, unknown or other
  misc_difference 700: note = a, t, c, g, unknown or other
  misc_difference 701: note = a, t, c, g, unknown or other
  misc_difference 702: note = a, t, c, g, unknown or other
  misc_difference 703: note = a, t, c, g, unknown or other
  misc_difference 704: note = a, t, c, g, unknown or other
  misc_difference 705: note = a, t, c, g, unknown or other
  misc_difference 706: note = a, t, c, g, unknown or other
  misc_difference 707: note = a, t, c, g, unknown or other
  misc_difference 708: note = a, t, c, g, unknown or other
  misc_difference 709: note = a, t, c, g, unknown or other
  misc_difference 710: note = a, t, c, g, unknown or other
  misc_difference 711: note = a, t, c, g, unknown or other
  misc_difference 712: note = a, t, c, g, unknown or other
  misc_difference 713: note = a, t, c, g, unknown or other
  misc_difference 714: note = a, t, c, g, unknown or other
  misc_difference 715: note = a, t, c, g, unknown or other
  misc_difference 716: note = a, t, c, g, unknown or other
  misc_difference 717: note = a, t, c, g, unknown or other
  misc_difference 718: note = a, t, c, g, unknown or other
  misc_difference 719: note = a, t, c, g, unknown or other
  misc_difference 720: note = a, t, c, g, unknown or other
  misc_difference 721: note = a, t, c, g, unknown or other
  misc_difference 722: note = a, t, c, g, unknown or other
  misc_difference 723: note = a, t, c, g, unknown or other
  misc_difference 724: note = a, t, c, g, unknown or other
  misc_difference 725: note = a, t, c, g, unknown or other
  misc_difference 726: note = a, t, c, g, unknown or other
  misc_difference 727: note = a, t, c, g, unknown or other
  misc_difference 728: note = a, t, c, g, unknown or other
  misc_difference 729: note = a, t, c, g, unknown or other
  misc_difference 730: note = a, t, c, g, unknown or other
  misc_difference 731: note = a, t, c, g, unknown or other
  misc_difference 732: note = a, t, c, g, unknown or other
  misc_difference 733: note = a, t, c, g, unknown or other
  misc_difference 734: note = a, t, c, g, unknown or other
  misc_difference 735: note = a, t, c, g, unknown or other
  misc_difference 736: note = a, t, c, g, unknown or other
  misc_difference 737: note = a, t, c, g, unknown or other
  misc_difference 738: note = a, t, c, g, unknown or other
  misc_difference 739: note = a, t, c, g, unknown or other
  misc_difference 740: note = a, t, c, g, unknown or other
  misc_difference 741: note = a, t, c, g, unknown or other
  misc_difference 742: note = a, t, c, g, unknown or other
  misc_difference 743: note = a, t, c, g, unknown or other
  misc_difference 744: note = a, t, c, g, unknown or other
  misc_difference 745: note = a, t, c, g, unknown or other
  misc_difference 746: note = a, t, c, g, unknown or other
  misc_difference 747: note = a, t, c, g, unknown or other
  misc_difference 748: note = a, t, c, g, unknown or other
  misc_difference 749: note = a, t, c, g, unknown or other
  misc_difference 750: note = a, t, c, g, unknown or other
  misc_difference 751: note = a, t, c, g, unknown or other
  misc_difference 752: note = a, t, c, g, unknown or other
  misc_difference 753: note = a, t, c, g, unknown or other
  misc_difference 754: note = a, t, c, g, unknown or other
  misc_difference 755: note = a, t, c, g, unknown or other
  misc_difference 756: note = a, t, c, g, unknown or other
  misc_difference 757: note = a, t, c, g, unknown or other
  misc_difference 758: note = a, t, c, g, unknown or other
  misc_difference 759: note = a, t, c, g, unknown or other
  misc_difference 760: note = a, t, c, g, unknown or other
  misc_difference 761: note = a, t, c, g, unknown or other
  misc_difference 762: note = a, t, c, g, unknown or other
  misc_difference 763: note = a, t, c, g, unknown or other
  misc_difference 764: note = a, t, c, g, unknown or other
  misc_difference 765: note = a, t, c, g, unknown or other
  misc_difference 766: note = a, t, c, g, unknown or other
  misc_difference 767: note = a, t, c, g, unknown or other
  misc_difference 768: note = a, t, c, g, unknown or other
  misc_difference 769: note = a, t, c, g, unknown or other
  misc_difference 770: note = a, t, c, g, unknown or other
  misc_difference 771: note = a, t, c, g, unknown or other
  misc_difference 772: note = a, t, c, g, unknown or other
  misc_difference 773: note = a, t, c, g, unknown or other
  misc_difference 774: note = a, t, c, g, unknown or other
  misc_difference 775: note = a, t, c, g, unknown or other
  misc_difference 776: note = a, t, c, g, unknown or other
  misc_difference 777: note = a, t, c, g, unknown or other
  misc_difference 778: note = a, t, c, g, unknown or other
  misc_difference 779: note = a, t, c, g, unknown or other
  misc_difference 780: note = a, t, c, g, unknown or other
  misc_difference 781: note = a, t, c, g, unknown or other
  misc_difference 782: note = a, t, c, g, unknown or other
  misc_difference 783: note = a, t, c, g, unknown or other
  misc_difference 784: note = a, t, c, g, unknown or other
  misc_difference 785: note = a, t, c, g, unknown or other
  misc_difference 786: note = a, t, c, g, unknown or other
  misc_difference 787: note = a, t, c, g, unknown or other
  misc_difference 788: note = a, t, c, g, unknown or other
  misc_difference 789: note = a, t, c, g, unknown or other
  misc_difference 790: note = a, t, c, g, unknown or other
  misc_difference 791: note = a, t, c, g, unknown or other
  misc_difference 792: note = a, t, c, g, unknown or other
  misc_difference 793: note = a, t, c, g, unknown or other
  misc_difference 794: note = a, t, c, g, unknown or other
  misc_difference 795: note = a, t, c, g, unknown or other
  misc_difference 796: note = a, t, c, g, unknown or other
  misc_difference 797: note = a, t, c, g, unknown or other
  misc_difference 798: note = a, t, c, g, unknown or other
  misc_difference 799: note = a, t, c, g, unknown or other
  misc_difference 800: note = a, t, c, g, unknown or other
  misc_difference 801: note = a, t, c, g, unknown or other
  misc_difference 802: note = a, t, c, g, unknown or other
  misc_difference 803: note = a, t, c, g, unknown or other
  misc_difference 804: note = a, t, c, g, unknown or other
  misc_difference 805: note = a, t, c, g, unknown or other
  misc_difference 806: note = a, t, c, g, unknown or other
  misc_difference 807: note = a, t, c, g, unknown or other
  misc_difference 808: note = a, t, c, g, unknown or other
  misc_difference 809: note = a, t, c, g, unknown or other
  misc_difference 810: note = a, t, c, g, unknown or other
  misc_difference 811: note = a, t, c, g, unknown or other
  misc_difference 812: note = a, t, c, g, unknown or other
  misc_difference 813: note = a, t, c, g, unknown or other
  misc_difference 814: note = a, t, c, g, unknown or other
  misc_difference 815: note = a, t, c, g, unknown or other
  misc_difference 816: note = a, t, c, g, unknown or other
  misc_difference 817: note = a, t, c, g, unknown or other
  misc_difference 818: note = a, t, c, g, unknown or other
  misc_difference 819: note = a, t, c, g, unknown or other
  misc_difference 820: note = a, t, c, g, unknown or other
  misc_difference 821: note = a, t, c, g, unknown or other
  misc_difference 822: note = a, t, c, g, unknown or other
  misc_difference 823: note = a, t, c, g, unknown or other
  misc_difference 824: note = a, t, c, g, unknown or other
  misc_difference 825: note = a, t, c, g, unknown or other
  misc_difference 826: note = a, t, c, g, unknown or other
  misc_difference 827: note = a, t, c, g, unknown or other
  misc_difference 828: note = a, t, c, g, unknown or other
  misc_difference 829: note = a, t, c, g, unknown or other
  misc_difference 830: note = a, t, c, g, unknown or other
  misc_difference 831: note = a, t, c, g, unknown or other
  misc_difference 832: note = a, t, c, g, unknown or other
  misc_difference 833: note = a, t, c, g, unknown or other
  misc_difference 834: note = a, t, c, g, unknown or other
  misc_difference 835: note = a, t, c, g, unknown or other
  misc_difference 836: note = a, t, c, g, unknown or other
  misc_difference 837: note = a, t, c, g, unknown or other
  misc_difference 838: note = a, t, c, g, unknown or other
  misc_difference 839: note = a, t, c, g, unknown or other
  misc_difference 840: note = a, t, c, g, unknown or other
  misc_difference 841: note = a, t, c, g, unknown or other
  misc_difference 842: note = a, t, c, g, unknown or other
  misc_difference 843: note = a, t, c, g, unknown or other
  misc_difference 844: note = a, t, c, g, unknown or other
  misc_difference 845: note = a, t, c, g, unknown or other
  misc_difference 846: note = a, t, c, g, unknown or other
  misc_difference 847: note = a, t, c, g, unknown or other
  misc_difference 848: note = a, t, c, g, unknown or other
  misc_difference 849: note = a, t, c, g, unknown or other
  misc_difference 850: note = a, t, c, g, unknown or other
  misc_difference 851: note = a, t, c, g, unknown or other
  misc_difference 852: note = a, t, c, g, unknown or other
  misc_difference 853: note = a, t, c, g, unknown or other
  misc_difference 854: note = a, t, c, g, unknown or other
  misc_difference 855: note = a, t, c, g, unknown or other
  misc_difference 856: note = a, t, c, g, unknown or other
  misc_difference 857: note = a, t, c, g, unknown or other
  misc_difference 858: note = a, t, c, g, unknown or other
  misc_difference 859: note = a, t, c, g, unknown or other
  misc_difference 860: note = a, t, c, g, unknown or other
  misc_difference 861: note = a, t, c, g, unknown or other
  misc_difference 862: note = a, t, c, g, unknown or other
  misc_difference 863: note = a, t, c, g, unknown or other
  misc_difference 864: note = a, t, c, g, unknown or other
  misc_difference 865: note = a, t, c, g, unknown or other
  misc_difference 866: note = a, t, c, g, unknown or other
  misc_difference 867: note = a, t, c, g, unknown or other
  misc_difference 868: note = a, t, c, g, unknown or other
  misc_difference 869: note = a, t, c, g, unknown or other
  misc_difference 870: note = a, t, c, g, unknown or other
  misc_difference 871: note = a, t, c, g, unknown or other
  misc_difference 872: note = a, t, c, g, unknown or other
  misc_difference 873: note = a, t, c, g, unknown or other
  misc_difference 874: note = a, t, c, g, unknown or other
  misc_difference 875: note = a, t, c, g, unknown or other
  misc_difference 876: note = a, t, c, g, unknown or other
  misc_difference 877: note = a, t, c, g, unknown or other
  misc_difference 878: note = a, t, c, g, unknown or other
  misc_difference 879: note = a, t, c, g, unknown or other
  misc_difference 880: note = a, t, c, g, unknown or other
  misc_difference 881: note = a, t, c, g, unknown or other
  misc_difference 882: note = a, t, c, g, unknown or other
  misc_difference 883: note = a, t, c, g, unknown or other
  misc_difference 884: note = a, t, c, g, unknown or other
  misc_difference 885: note = a, t, c, g, unknown or other
  misc_difference 886: note = a, t, c, g, unknown or other
  misc_difference 887: note = a, t, c, g, unknown or other
  misc_difference 888: note = a, t, c, g, unknown or other
  misc_difference 889: note = a, t, c, g, unknown or other
  misc_difference 890: note = a, t, c, g, unknown or other
  misc_difference 891: note = a, t, c, g, unknown or other
  misc_difference 892: note = a, t, c, g, unknown or other
  misc_difference 893: note = a, t, c, g, unknown or other
  misc_difference 894: note = a, t, c, g, unknown or other
  misc_difference 895: note = a, t, c, g, unknown or other
  misc_difference 896: note = a, t, c, g, unknown or other
  misc_difference 897: note = a, t, c, g, unknown or other
  misc_difference 898: note = a, t, c, g, unknown or other
  misc_difference 899: note = a, t, c, g, unknown or other
  misc_difference 900: note = a, t, c, g, unknown or other
  misc_difference 901: note = a, t, c, g, unknown or other
  misc_difference 902: note = a, t, c, g, unknown or other
  misc_difference 903: note = a, t, c, g, unknown or other
  misc_difference 904: note = a, t, c, g, unknown or other
  misc_difference 905: note = a, t, c, g, unknown or other
  misc_difference 906: note = a, t, c, g, unknown or other
  misc_difference 907: note = a, t, c, g, unknown or other
  misc_difference 908: note = a, t, c, g, unknown or other
  misc_difference 909: note = a, t, c, g, unknown or other
  misc_difference 910: note = a, t, c, g, unknown or other
  misc_difference 911: note = a, t, c, g, unknown or other
  misc_difference 912: note = a, t, c, g, unknown or other
  misc_difference 913: note = a, t, c, g, unknown or other
  misc_difference 914: note = a, t, c, g, unknown or other
  misc_difference 915: note = a, t, c, g, unknown or other
  misc_difference 916: note = a, t, c, g, unknown or other
  misc_difference 917: note = a, t, c, g, unknown or other
  misc_difference 918: note = a, t, c, g, unknown or other
  misc_difference 919: note = a, t, c, g, unknown or other
  misc_difference 920: note = a, t, c, g, unknown or other
  misc_difference 921: note = a, t, c, g, unknown or other
  misc_difference 922: note = a, t, c, g, unknown or other
  misc_difference 923: note = a, t, c, g, unknown or other
  misc_difference 924: note = a, t, c, g, unknown or other
  misc_difference 925: note = a, t, c, g, unknown or other
  misc_difference 926: note = a, t, c, g, unknown or other
  misc_difference 927: note = a, t, c, g, unknown or other
  misc_difference 928: note = a, t, c, g, unknown or other
  misc_difference 929: note = a, t, c, g, unknown or other
  misc_difference 930: note = a, t, c, g, unknown or other
  misc_difference 931: note = a, t, c, g, unknown or other
  misc_difference 932: note = a, t, c, g, unknown or other
  misc_difference 933: note = a, t, c, g, unknown or other
  misc_difference 934: note = a, t, c, g, unknown or other
  misc_difference 935: note = a, t, c, g, unknown or other
  misc_difference 936: note = a, t, c, g, unknown or other
  misc_difference 937: note = a, t, c, g, unknown or other
  misc_difference 938: note = a, t, c, g, unknown or other
  misc_difference 939: note = a, t, c, g, unknown or other
  misc_difference 940: note = a, t, c, g, unknown or other
  misc_difference 941: note = a, t, c, g, unknown or other
  misc_difference 942: note = a, t, c, g, unknown or other
  misc_difference 943: note = a, t, c, g, unknown or other
  misc_difference 944: note = a, t, c, g, unknown or other
  misc_difference 945: note = a, t, c, g, unknown or other
  misc_difference 946: note = a, t, c, g, unknown or other
  misc_difference 947: note = a, t, c, g, unknown or other
  misc_difference 948: note = a, t, c, g, unknown or other
  misc_difference 949: note = a, t, c, g, unknown or other
  misc_difference 950: note = a, t, c, g, unknown or other
  misc_difference 951: note = a, t, c, g, unknown or other
  misc_difference 952: note = a, t, c, g, unknown or other
  misc_difference 953: note = a, t, c, g, unknown or other
  misc_difference 954: note = a, t, c, g, unknown or other
  misc_difference 955: note = a, t, c, g, unknown or other
  misc_difference 956: note = a, t, c, g, unknown or other
  misc_difference 957: note = a, t, c, g, unknown or other
  misc_difference 958: note = a, t, c, g, unknown or other
  misc_difference 959: note = a, t, c, g, unknown or other
  misc_difference 960: note = a, t, c, g, unknown or other
  misc_difference 961: note = a, t, c, g, unknown or other
  misc_difference 962: note = a, t, c, g, unknown or other
  misc_difference 963: note = a, t, c, g, unknown or other
  misc_difference 964: note = a, t, c, g, unknown or other
  misc_difference 965: note = a, t, c, g, unknown or other
  misc_difference 966: note = a, t, c, g, unknown or other
  misc_difference 967: note = a, t, c, g, unknown or other
  misc_difference 968: note = a, t, c, g, unknown or other
  misc_difference 969: note = a, t, c, g, unknown or other
  misc_difference 970: note = a, t, c, g, unknown or other
  misc_difference 971: note = a, t, c, g, unknown or other
  misc_difference 972: note = a, t, c, g, unknown or other
  misc_difference 973: note = a, t, c, g, unknown or other
  misc_difference 974: note = a, t, c, g, unknown or other
  misc_difference 975: note = a, t, c, g, unknown or other
  misc_difference 976: note = a, t, c, g, unknown or other
  misc_difference 977: note = a, t, c, g, unknown or other
  misc_difference 978: note = a, t, c, g, unknown or other
  misc_difference 979: note = a, t, c, g, unknown or other
  misc_difference 980: note = a, t, c, g, unknown or other
  misc_difference 981: note = a, t, c, g, unknown or other
  misc_difference 982: note = a, t, c, g, unknown or other
  misc_difference 983: note = a, t, c, g, unknown or other
  misc_difference 984: note = a, t, c, g, unknown or other
  misc_difference 985: note = a, t, c, g, unknown or other
  misc_difference 986: note = a, t, c, g, unknown or other
  misc_difference 987: note = a, t, c, g, unknown or other
  misc_difference 988: note = a, t, c, g, unknown or other
  misc_difference 989: note = a, t, c, g, unknown or other
  misc_difference 990: note = a, t, c, g, unknown or other
  misc_difference 991: note = a, t, c, g, unknown or other
  misc_difference 992: note = a, t, c, g, unknown or other
  misc_difference 993: note = a, t, c, g, unknown or other
  misc_difference 994: note = a, t, c, g, unknown or other
  misc_difference 995: note = a, t, c, g, unknown or other
  misc_difference 996: note = a, t, c, g, unknown or other
  misc_difference 997: note = a, t, c, g, unknown or other
  misc_difference 998: note = a, t, c, g, unknown or other
  misc_difference 999: note = a, t, c, g, unknown or other
  misc_difference 1000: note = a, t, c, g, unknown or other
  misc_difference 1001..1033: note = a, t, c, g, unknown or other
  modified_base 1052: mod_base = OTHER; note = hydroxy cytidine
aggtcgccagccctacagtcagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtcaaggtcgccagccc

SEQ ID NO: 2 - DNA, 1052 bp, synthetic construct
  source 1..1052: mol_type = other DNA
  modified_base 5: mod_base = OTHER; note = Uracil
  modified_base 13: mod_base = OTHER; note = Uracil
  misc_difference 20: note = a, t, c, g, unknown or other
  misc_difference 21: note = a, t, c, g, unknown or other
  misc_difference 22: note = a, t, c, g, unknown or other
  misc_difference 23: note = a, t, c, g, unknown or other
  misc_difference 24: note = a, t, c, g, unknown or other
  misc_difference 25: note = a, t, c, g, unknown or other
  misc_difference 26: note = a, t, c, g, unknown or other
  misc_difference 27: note = a, t, c, g, unknown or other
  misc_difference 28: note = a, t, c, g, unknown or other
  misc_difference 29: note = a, t, c, g, unknown or other
  misc_difference 30: note = a, t, c, g, unknown or other
  misc_difference 31: note = a, t, c, g, unknown or other
  misc_difference 32: note = a, t, c, g, unknown or other
  misc_difference 33: note = a, t, c, g, unknown or other
  misc_difference 34: note = a, t, c, g, unknown or other
  misc_difference 35: note = a, t, c, g, unknown or other
  misc_difference 36: note = a, t, c, g, unknown or other
  misc_difference 37: note = a, t, c, g, unknown or other
  misc_difference 38: note = a, t, c, g, unknown or other
  misc_difference 39: note = a, t, c, g, unknown or other
  misc_difference 40: note = a, t, c, g, unknown or other
  misc_difference 41: note = a, t, c, g, unknown or other
  misc_difference 42: note = a, t, c, g, unknown or other
  misc_difference 43: note = a, t, c, g, unknown or other
  misc_difference 44: note = a, t, c, g, unknown or other
  misc_difference 45: note = a, t, c, g, unknown or other
  misc_difference 46: note = a, t, c, g, unknown or other
  misc_difference 47: note = a, t, c, g, unknown or other
  misc_difference 48: note = a, t, c, g, unknown or other
  misc_difference 49: note = a, t, c, g, unknown or other
  misc_difference 50: note = a, t, c, g, unknown or other
  misc_difference 51: note = a, t, c, g, unknown or other
  misc_difference 52: note = a, t, c, g, unknown or other
  misc_difference 53: note = a, t, c, g, unknown or other
  misc_difference 54: note = a, t, c, g, unknown or other
  misc_difference 55: note = a, t, c, g, unknown or other
  misc_difference 56: note = a, t, c, g, unknown or other
  misc_difference 57: note = a, t, c, g, unknown or other
  misc_difference 58: note = a, t, c, g, unknown or other
  misc_difference 59: note = a, t, c, g, unknown or other
  misc_difference 60: note = a, t, c, g, unknown or other
  misc_difference 61: note = a, t, c, g, unknown or other
  misc_difference 62: note = a, t, c, g, unknown or other
  misc_difference 63: note = a, t, c, g, unknown or other
  misc_difference 64: note = a, t, c, g, unknown or other
  misc_difference 65: note = a, t, c, g, unknown or other
  misc_difference 66: note = a, t, c, g, unknown or other
  misc_difference 67: note = a, t, c, g, unknown or other
  misc_difference 68: note = a, t, c, g, unknown or other
  misc_difference 69: note = a, t, c, g, unknown or other
  misc_difference 70: note = a, t, c, g, unknown or other
  misc_difference 71: note = a, t, c, g, unknown or other
  misc_difference 72: note = a, t, c, g, unknown or other
  misc_difference 73: note = a, t, c, g, unknown or other
  misc_difference 74: note = a, t, c, g, unknown or other
  misc_difference 75: note = a, t, c, g, unknown or other
  misc_difference 76: note = a, t, c, g, unknown or other
  misc_difference 77: note = a, t, c, g, unknown or other
  misc_difference 78: note = a, t, c, g, unknown or other
  misc_difference 79: note = a, t, c, g, unknown or other
  misc_difference 80: note = a, t, c, g, unknown or other
  misc_difference 81: note = a, t, c, g, unknown or other
  misc_difference 82: note = a, t, c, g, unknown or other
  misc_difference 83: note = a, t, c, g, unknown or other
  misc_difference 84: note = a, t, c, g, unknown or other
  misc_difference 85: note = a, t, c, g, unknown or other
  misc_difference 86: note = a, t, c, g, unknown or other
  misc_difference 87: note = a, t, c, g, unknown or other
  misc_difference 88: note = a, t, c, g, unknown or other
  misc_difference 89: note = a, t, c, g, unknown or other
  misc_difference 90: note = a, t, c, g, unknown or other
  misc_difference 91: note = a, t, c, g, unknown or other
  misc_difference 92: note = a, t, c, g, unknown or other
  misc_difference 93: note = a, t, c, g, unknown or other
  misc_difference 94: note = a, t, c, g, unknown or other
  misc_difference 95: note = a, t, c, g, unknown or other
  misc_difference 96: note = a, t, c, g, unknown or other
  misc_difference 97: note = a, t, c, g, unknown or other
  misc_difference 98: note = a, t, c, g, unknown or other
  misc_difference 99: note = a, t, c, g, unknown or other
  misc_difference 100: note = a, t, c, g, unknown or other
  misc_difference 101: note = a, t, c, g, unknown or other
  misc_difference 102: note = a, t, c, g, unknown or other
  misc_difference 103: note = a, t, c, g, unknown or other
  misc_difference 104: note = a, t, c, g, unknown or other
  misc_difference 105: note = a, t, c, g, unknown or other
  misc_difference 106: note = a, t, c, g, unknown or other
  misc_difference 107: note = a, t, c, g, unknown or other
  misc_difference 108: note = a, t, c, g, unknown or other
  misc_difference 109: note = a, t, c, g, unknown or other
  misc_difference 110: note = a, t, c, g, unknown or other
  misc_difference 111: note = a, t, c, g, unknown or other
  misc_difference 112: note = a, t, c, g, unknown or other
  misc_difference 113: note = a, t, c, g, unknown or other
  misc_difference 114: note = a, t, c, g, unknown or other
  misc_difference 115: note = a, t, c, g, unknown or other
  misc_difference 116: note = a, t, c, g, unknown or other
  misc_difference 117: note = a, t, c, g, unknown or other
  misc_difference 118: note = a, t, c, g, unknown or other
  misc_difference 119: note = a, t, c, g, unknown or other
  misc_difference 120: note = a, t, c, g, unknown or other
  misc_difference 121: note = a, t, c, g, unknown or other
  misc_difference 122: note = a, t, c, g, unknown or other
  misc_difference 123: note = a, t, c, g, unknown or other
  misc_difference 124: note = a, t, c, g, unknown or other
  misc_difference 125: note = a, t, c, g, unknown or other
  misc_difference 126: note = a, t, c, g, unknown or other
  misc_difference 127: note = a, t, c, g, unknown or other
  misc_difference 128: note = a, t, c, g, unknown or other
  misc_difference 129: note = a, t, c, g, unknown or other
  misc_difference 130: note = a, t, c, g, unknown or other
  misc_difference 131: note = a, t, c, g, unknown or other
  misc_difference 132: note = a, t, c, g, unknown or other
  misc_difference 133: note = a, t, c, g, unknown or other
  misc_difference 134: note = a, t, c, g, unknown or other
  misc_difference 135: note = a, t, c, g, unknown or other
  misc_difference 136: note = a, t, c, g, unknown or other
  misc_difference 137: note = a, t, c, g, unknown or other
  misc_difference 138: note = a, t, c, g, unknown or other
  misc_difference 139: note = a, t, c, g, unknown or other
  misc_difference 140: note = a, t, c, g, unknown or other
  misc_difference 141: note = a, t, c, g, unknown or other
  misc_difference 142: note = a, t, c, g, unknown or other
  misc_difference 143: note = a, t, c, g, unknown or other
  misc_difference 144: note = a, t, c, g, unknown or other
  misc_difference 145: note = a, t, c, g, unknown or other
  misc_difference 146: note = a, t, c, g, unknown or other
  misc_difference 147: note = a, t, c, g, unknown or other
  misc_difference 148: note = a, t, c, g, unknown or other
  misc_difference 149: note = a, t, c, g, unknown or other
  misc_difference 150: note = a, t, c, g, unknown or other
  misc_difference 151: note = a, t, c, g, unknown or other
  misc_difference 152: note = a, t, c, g, unknown or other
  misc_difference 153: note = a, t, c, g, unknown or other
  misc_difference 154: note = a, t, c, g, unknown or other
  misc_difference 155: note = a, t, c, g, unknown or other
  misc_difference 156: note = a, t, c, g, unknown or other
  misc_difference 157: note = a, t, c, g, unknown or other
  misc_difference 158: note = a, t, c, g, unknown or other
  misc_difference 159: note = a, t, c, g, unknown or other
  misc_difference 160: note = a, t, c, g, unknown or other
  misc_difference 161: note = a, t, c, g, unknown or other
  misc_difference 162: note = a, t, c, g, unknown or other
  misc_difference 163: note = a, t, c, g, unknown or other
  misc_difference 164: note = a, t, c, g, unknown or other
  misc_difference 165: note = a, t, c, g, unknown or other
  misc_difference 166: note = a, t, c, g, unknown or other
  misc_difference 167: note = a, t, c, g, unknown or other
  misc_difference 168: note = a, t, c, g, unknown or other
  misc_difference 169: note = a, t, c, g, unknown or other
  misc_difference 170: note = a, t, c, g, unknown or other
  misc_difference 171: note = a, t, c, g, unknown or other
  misc_difference 172: note = a, t, c, g, unknown or other
  misc_difference 173: note = a, t, c, g, unknown or other
  misc_difference 174: note = a, t, c, g, unknown or other
  misc_difference 175: note = a, t, c, g, unknown or other
  misc_difference 176: note = a, t, c, g, unknown or other
  misc_difference 177: note = a, t, c, g, unknown or other
  misc_difference 178: note = a, t, c, g, unknown or other
  misc_difference 179: note = a, t, c, g, unknown or other
  misc_difference 180: note = a, t, c, g, unknown or other
  misc_difference 181: note = a, t, c, g, unknown or other
  misc_difference 182: note = a, t, c, g, unknown or other
  misc_difference 183: note = a, t, c, g, unknown or other
  misc_difference 184: note = a, t, c, g, unknown or other
  misc_difference 185: note = a, t, c, g, unknown or other
  misc_difference 186: note = a, t, c, g, unknown or other
  misc_difference 187: note = a, t, c, g, unknown or other
  misc_difference 188: note = a, t, c, g, unknown or other
  misc_difference 189: note = a, t, c, g, unknown or other
  misc_difference 190: note = a, t, c, g, unknown or other
  misc_difference 191: note = a, t, c, g, unknown or other
  misc_difference 192: note = a, t, c, g, unknown or other
  misc_difference 193: note = a, t, c, g, unknown or other
  misc_difference 194: note = a, t, c, g, unknown or other
  misc_difference 195: note = a, t, c, g, unknown or other
  misc_difference 196: note = a, t, c, g, unknown or other
  misc_difference 197: note = a, t, c, g, unknown or other
  misc_difference 198: note = a, t, c, g, unknown or other
  misc_difference 199: note = a, t, c, g, unknown or other
  misc_difference 200: note = a, t, c, g, unknown or other
  misc_difference 201: note = a, t, c, g, unknown or other
  misc_difference 202: note = a, t, c, g, unknown or other
  misc_difference 203: note = a, t, c, g, unknown or other
  misc_difference 204: note = a, t, c, g, unknown or other
  misc_difference 205: note = a, t, c, g, unknown or other
  misc_difference 206: note = a, t, c, g, unknown or other
  misc_difference 207: note = a, t, c, g, unknown or other
  misc_difference 208: note = a, t, c, g, unknown or other
  misc_difference 209: note = a, t, c, g, unknown or other
  misc_difference 210: note = a, t, c, g, unknown or other
  misc_difference 211: note = a, t, c, g, unknown or other
  misc_difference 212: note = a, t, c, g, unknown or other
  misc_difference 213: note = a, t, c, g, unknown or other
  misc_difference 214: note = a, t, c, g, unknown or other
  misc_difference 215: note = a, t, c, g, unknown or other
  misc_difference 216: note = a, t, c, g, unknown or other
  misc_difference 217: note = a, t, c, g, unknown or other
  misc_difference 218: note = a, t, c, g, unknown or other
  misc_difference 219: note = a, t, c, g, unknown or other
  misc_difference 220: note = a, t, c, g, unknown or other
  misc_difference 221: note = a, t, c, g, unknown or other
  misc_difference 222: note = a, t, c, g, unknown or other
  misc_difference 223: note = a, t, c, g, unknown or other
  misc_difference 224: note = a, t, c, g, unknown or other
  misc_difference 225: note = a, t, c, g, unknown or other
  misc_difference 226: note = a, t, c, g, unknown or other
  misc_difference 227: note = a, t, c, g, unknown or other
  misc_difference 228: note = a, t, c, g, unknown or other
  misc_difference 229: note = a, t, c, g, unknown or other
  misc_difference 230: note = a, t, c, g, unknown or other
  misc_difference 231: note = a, t, c, g, unknown or other
  misc_difference 232: note = a, t, c, g, unknown or other
  misc_difference 233: note = a, t, c, g, unknown or other
  misc_difference 234: note = a, t, c, g, unknown or other
  misc_difference 235: note = a, t, c, g, unknown or other
  misc_difference 236: note = a, t, c, g, unknown or other
  misc_difference 237: note = a, t, c, g, unknown or other
  misc_difference 238: note = a, t, c, g, unknown or other
  misc_difference 239: note = a, t, c, g, unknown or other
  misc_difference 240: note = a, t, c, g, unknown or other
  misc_difference 241: note = a, t, c, g, unknown or other
  misc_difference 242: note = a, t, c, g, unknown or other
  misc_difference 243: note = a, t, c, g, unknown or other
  misc_difference 244: note = a, t, c, g, unknown or other
  misc_difference 245: note = a, t, c, g, unknown or other
  misc_difference 246: note = a, t, c, g, unknown or other
  misc_difference 247: note = a, t, c, g, unknown or other
  misc_difference 248: note = a, t, c, g, unknown or other
  misc_difference 249: note = a, t, c, g, unknown or other
  misc_difference 250: note = a, t, c, g, unknown or other
  misc_difference 251: note = a, t, c, g, unknown or other
  misc_difference 252: note = a, t, c, g, unknown or other
  misc_difference 253: note = a, t, c, g, unknown or other
  misc_difference 254: note = a, t, c, g, unknown or other
  misc_difference 255: note = a, t, c, g, unknown or other
  misc_difference 256: note = a, t, c, g, unknown or other
  misc_difference 257: note = a, t, c, g, unknown or other
  misc_difference 258: note = a, t, c, g, unknown or other
  misc_difference 259: note = a, t, c, g, unknown or other
  misc_difference 260: note = a, t, c, g, unknown or other
  misc_difference 261: note = a, t, c, g, unknown or other
  misc_difference 262: note = a, t, c, g, unknown or other
  misc_difference 263: note = a, t, c, g, unknown or other
  misc_difference 264: note = a, t, c, g, unknown or other
  misc_difference 265: note = a, t, c, g, unknown or other
  misc_difference 266: note = a, t, c, g, unknown or other
  misc_difference 267: note = a, t, c, g, unknown or other
  misc_difference 268: note = a, t, c, g, unknown or other
  misc_difference 269: note = a, t, c, g, unknown or other
  misc_difference 270: note = a, t, c, g, unknown or other
  misc_difference 271: note = a, t, c, g, unknown or other
  misc_difference 272: note = a, t, c, g, unknown or other
  misc_difference 273: note = a, t, c, g, unknown or other
  misc_difference 274: note = a, t, c, g, unknown or other
  misc_difference 275: note = a, t, c, g, unknown or other
  misc_difference 276: note = a, t, c, g, unknown or other
  misc_difference 277: note = a, t, c, g, unknown or other
  misc_difference 278: note = a, t, c, g, unknown or other
  misc_difference 279: note = a, t, c, g, unknown or other
  misc_difference 280: note = a, t, c, g, unknown or other
  misc_difference 281: note = a, t, c, g, unknown or other
  misc_difference 282: note = a, t, c, g, unknown or other
  misc_difference 283: note = a, t, c, g, unknown or other
  misc_difference 284: note = a, t, c, g, unknown or other
  misc_difference 285: note = a, t, c, g, unknown or other
  misc_difference 286: note = a, t, c, g, unknown or other
  misc_difference 287: note = a, t, c, g, unknown or other
  misc_difference 288: note = a, t, c, g, unknown or other
  misc_difference 289: note = a, t, c, g, unknown or other
  misc_difference 290: note = a, t, c, g, unknown or other
  misc_difference 291: note = a, t, c, g, unknown or other
  misc_difference 292: note = a, t, c, g, unknown or other
  misc_difference 293: note = a, t, c, g, unknown or other
  misc_difference 294: note = a, t, c, g, unknown or other
  misc_difference 295: note = a, t, c, g, unknown or other
  misc_difference 296: note = a, t, c, g, unknown or other
  misc_difference 297: note = a, t, c, g, unknown or other
  misc_difference 298: note = a, t, c, g, unknown or other
  misc_difference 299: note = a, t, c, g, unknown or other
  misc_difference 300: note = a, t, c, g, unknown or other
  misc_difference 301: note = a, t, c, g, unknown or other
  misc_difference 302: note = a, t, c, g, unknown or other
  misc_difference 303: note = a, t, c, g, unknown or other
  misc_difference 304: note = a, t, c, g, unknown or other
  misc_difference 305: note = a, t, c, g, unknown or other
  misc_difference 306: note = a, t, c, g, unknown or other
  misc_difference 307: note = a, t, c, g, unknown or other
  misc_difference 308: note = a, t, c, g, unknown or other
  misc_difference 309: note = a, t, c, g, unknown or other
  misc_difference 310: note = a, t, c, g, unknown or other
  misc_difference 311: note = a, t, c, g, unknown or other
  misc_difference 312: note = a, t, c, g, unknown or other
  misc_difference 313: note = a, t, c, g, unknown or other
  misc_difference 314: note = a, t, c, g, unknown or other
  misc_difference 315: note = a, t, c, g, unknown or other
  misc_difference 316: note = a, t, c, g, unknown or other
  misc_difference 317: note = a, t, c, g, unknown or other
  misc_difference 318: note = a, t, c, g, unknown or other
  misc_difference 319: note = a, t, c, g, unknown or other
  misc_difference 320: note = a, t, c, g, unknown or other
  misc_difference 321: note = a, t, c, g, unknown or other
  misc_difference 322: note = a, t, c, g, unknown or other
  misc_difference 323: note = a, t, c, g, unknown or other
  misc_difference 324: note = a, t, c, g, unknown or other
  misc_difference 325: note = a, t, c, g, unknown or other
  misc_difference 326: note = a, t, c, g, unknown or other
  misc_difference 327: note = a, t, c, g, unknown or other
  misc_difference 328: note = a, t, c, g, unknown or other
  misc_difference 329: note = a, t, c, g, unknown or other
  misc_difference 330: note = a, t, c, g, unknown or other
  misc_difference 331: note = a, t, c, g, unknown or other
  misc_difference 332: note = a, t, c, g, unknown or other
  misc_difference 333: note = a, t, c, g, unknown or other
  misc_difference 334: note = a, t, c, g, unknown or other
  misc_difference 335: note = a, t, c, g, unknown or other
  misc_difference 336: note = a, t, c, g, unknown or other
  misc_difference 337: note = a, t, c, g, unknown or other
  misc_difference 338: note = a, t, c, g, unknown or other
  misc_difference 339: note = a, t, c, g, unknown or other
  misc_difference 340: note = a, t, c, g, unknown or other
  misc_difference 341: note = a, t, c, g, unknown or other
  misc_difference 342: note = a, t, c, g, unknown or other
  misc_difference 343: note = a, t, c, g, unknown or other
  misc_difference 344: note = a, t, c, g, unknown or other
  misc_difference 345: note = a, t, c, g, unknown or other
  misc_difference 346: note = a, t, c, g, unknown or other
  misc_difference 347: note = a, t, c, g, unknown or other
  misc_difference 348: note = a, t, c, g, unknown or other
  misc_difference 349: note = a, t, c, g, unknown or other
  misc_difference 350: note = a, t, c, g, unknown or other
  misc_difference 351: note = a, t, c, g, unknown or other
  misc_difference 352: note = a, t, c, g, unknown or other
  misc_difference 353: note = a, t, c, g, unknown or other
  misc_difference 354: note = a, t, c, g, unknown or other
  misc_difference 355: note = a, t, c, g, unknown or other
  misc_difference 356: note = a, t, c, g, unknown or other
  misc_difference 357: note = a, t, c, g, unknown or other
  misc_difference 358: note = a, t, c, g, unknown or other
  misc_difference 359: note = a, t, c, g, unknown or other
  misc_difference 360: note = a, t, c, g, unknown or other
  misc_difference 361: note = a, t, c, g, unknown or other
  misc_difference 362: note = a, t, c, g, unknown or other
  misc_difference 363: note = a, t, c, g, unknown or other
  misc_difference 364: note = a, t, c, g, unknown or other
  misc_difference 365: note = a, t, c, g, unknown or other
  misc_difference 366: note = a, t, c, g, unknown or other
  misc_difference 367: note = a, t, c, g, unknown or other
  misc_difference 368: note = a, t, c, g, unknown or other
  misc_difference 369: note = a, t, c, g, unknown or other
  misc_difference 370: note = a, t, c, g, unknown or other
  misc_difference 371: note = a, t, c, g, unknown or other
  misc_difference 372: note = a, t, c, g, unknown or other
  misc_difference 373: note = a, t, c, g, unknown or other
  misc_difference 374: note = a, t, c, g, unknown or other
  misc_difference 375: note = a, t, c, g, unknown or other
  misc_difference 376: note = a, t, c, g, unknown or other
  misc_difference 377: note = a, t, c, g, unknown or other
  misc_difference 378: note = a, t, c, g, unknown or other
  misc_difference 379: note = a, t, c, g, unknown or other
  misc_difference 380: note = a, t, c, g, unknown or other
  misc_difference 381: note = a, t, c, g, unknown or other
  misc_difference 382: note = a, t, c, g, unknown or other
  misc_difference 383: note = a, t, c, g, unknown or other
  misc_difference 384: note = a, t, c, g, unknown or other
  misc_difference 385: note = a, t, c, g, unknown or other
  misc_difference 386: note = a, t, c, g, unknown or other
  misc_difference 387: note = a, t, c, g, unknown or other
  misc_difference 388: note = a, t, c, g, unknown or other
  misc_difference 389: note = a, t, c, g, unknown or other
  misc_difference 390: note = a, t, c, g, unknown or other
  misc_difference 391: note = a, t, c, g, unknown or other
  misc_difference 392: note = a, t, c, g, unknown or other
  misc_difference 393: note = a, t, c, g, unknown or other
  misc_difference 394: note = a, t, c, g, unknown or other
  misc_difference 395: note = a, t, c, g, unknown or other
  misc_difference 396: note = a, t, c, g, unknown or other
  misc_difference 397: note = a, t, c, g, unknown or other
  misc_difference 398: note = a, t, c, g, unknown or other
  misc_difference 399: note = a, t, c, g, unknown or other
  misc_difference 400: note = a, t, c, g, unknown or other
  misc_difference 401: note = a, t, c, g, unknown or other
  misc_difference 402: note = a, t, c, g, unknown or other
  misc_difference 403: note = a, t, c, g, unknown or other
  misc_difference 404: note = a, t, c, g, unknown or other
  misc_difference 405: note = a, t, c, g, unknown or other
  misc_difference 406: note = a, t, c, g, unknown or other
  misc_difference 407: note = a, t, c, g, unknown or other
  misc_difference 408: note = a, t, c, g, unknown or other
  misc_difference 409: note = a, t, c, g, unknown or other
  misc_difference 410: note = a, t, c, g, unknown or other
  misc_difference 411: note = a, t, c, g, unknown or other
  misc_difference 412: note = a, t, c, g, unknown or other
  misc_difference 413: note = a, t, c, g, unknown or other
  misc_difference 414: note = a, t, c, g, unknown or other
  misc_difference 415: note = a, t, c, g, unknown or other
  misc_difference 416: note = a, t, c, g, unknown or other
  misc_difference 417: note = a, t, c, g, unknown or other
  misc_difference 418: note = a, t, c, g, unknown or other
  misc_difference 419: note = a, t, c, g, unknown or other
  misc_difference 420: note = a, t, c, g, unknown or other
  misc_difference 421: note = a, t, c, g, unknown or other
  misc_difference 422: note = a, t, c, g, unknown or other
  misc_difference 423: note = a, t, c, g, unknown or other
  misc_difference 424: note = a, t, c, g, unknown or other
  misc_difference 425: note = a, t, c, g, unknown or other
  misc_difference 426: note = a, t, c, g, unknown or other
  misc_difference 427: note = a, t, c, g, unknown or other
  misc_difference 428: note = a, t, c, g, unknown or other
  misc_difference 429: note = a, t, c, g, unknown or other
  misc_difference 430: note = a, t, c, g, unknown or other
  misc_difference 431: note = a, t, c, g, unknown or other
  misc_difference 432: note = a, t, c, g, unknown or other
  misc_difference 433: note = a, t, c, g, unknown or other
  misc_difference 434: note = a, t, c, g, unknown or other
  misc_difference 435: note = a, t, c, g, unknown or other
  misc_difference 436: note = a, t, c, g, unknown or other
  misc_difference 437: note = a, t, c, g, unknown or other
  misc_difference 438: note = a, t, c, g, unknown or other
  misc_difference 439: note = a, t, c, g, unknown or other
  misc_difference 440: note = a, t, c, g, unknown or other
  misc_difference 441: note = a, t, c, g, unknown or other
  misc_difference 442: note = a, t, c, g, unknown or other
  misc_difference 443: note = a, t, c, g, unknown or other
  misc_difference 444: note = a, t, c, g, unknown or other
  misc_difference 445: note = a, t, c, g, unknown or other
  misc_difference 446: note = a, t, c, g, unknown or other
  misc_difference 447: note = a, t, c, g, unknown or other
  misc_difference 448: note = a, t, c, g, unknown or other
  misc_difference 449: note = a, t, c, g, unknown or other
  misc_difference 450: note = a, t, c, g, unknown or other
  misc_difference 451: note = a, t, c, g, unknown or other
  misc_difference 452: note = a, t, c, g, unknown or other
  misc_difference 453: note = a, t, c, g, unknown or other
  misc_difference 454: note = a, t, c, g, unknown or other
  misc_difference 455: note = a, t, c, g, unknown or other
  misc_difference 456: note = a, t, c, g, unknown or other
  misc_difference 457: note = a, t, c, g, unknown or other
  misc_difference 458: note = a, t, c, g, unknown or other
  misc_difference 459: note = a, t, c, g, unknown or other
  misc_difference 460: note = a, t, c, g, unknown or other
  misc_difference 461: note = a, t, c, g, unknown or other
  misc_difference 462: note = a, t, c, g, unknown or other
  misc_difference 463: note = a, t, c, g, unknown or other
  misc_difference 464: note = a, t, c, g, unknown or other
  misc_difference 465: note = a, t, c, g, unknown or other
  misc_difference 466: note = a, t, c, g, unknown or other
  misc_difference 467: note = a, t, c, g, unknown or other
  misc_difference 468: note = a, t, c, g, unknown or other
  misc_difference 469: note = a, t, c, g, unknown or other
  misc_difference 470: note = a, t, c, g, unknown or other
  misc_difference 471: note = a, t, c, g, unknown or other
  misc_difference 472: note = a, t, c, g, unknown or other
  misc_difference 473: note = a, t, c, g, unknown or other
  misc_difference 474: note = a, t, c, g, unknown or other
  misc_difference 475: note = a, t, c, g, unknown or other
  misc_difference 476: note = a, t, c, g, unknown or other
  misc_difference 477: note = a, t, c, g, unknown or other
  misc_difference 478: note = a, t, c, g, unknown or other
  misc_difference 479: note = a, t, c, g, unknown or other
  misc_difference 480: note = a, t, c, g, unknown or other
  misc_difference 481: note = a, t, c, g, unknown or other
  misc_difference 482: note = a, t, c, g, unknown or other
  misc_difference 483: note = a, t, c, g, unknown or other
  misc_difference 484: note = a, t, c, g, unknown or other
  misc_difference 485: note = a, t, c, g, unknown or other
  misc_difference 486: note = a, t, c, g, unknown or other
  misc_difference 487: note = a, t, c, g, unknown or other
  misc_difference 488: note = a, t, c, g, unknown or other
  misc_difference 489: note = a, t, c, g, unknown or other
  misc_difference 490: note = a, t, c, g, unknown or other
  misc_difference 491: note = a, t, c, g, unknown or other
  misc_difference 492: note = a, t, c, g, unknown or other
  misc_difference 493: note = a, t, c, g, unknown or other
  misc_difference 494: note = a, t, c, g, unknown or other
  misc_difference 495: note = a, t, c, g, unknown or other
  misc_difference 496: note = a, t, c, g, unknown or other
  misc_difference 497: note = a, t, c, g, unknown or other
  misc_difference 498: note = a, t, c, g, unknown or other
  misc_difference 499: note = a, t, c, g, unknown or other
  misc_difference 500: note = a, t, c, g, unknown or other
  misc_difference 501: note = a, t, c, g, unknown or other
  misc_difference 502: note = a, t, c, g, unknown or other
  misc_difference 503: note = a, t, c, g, unknown or other
  misc_difference 504: note = a, t, c, g, unknown or other
  misc_difference 505: note = a, t, c, g, unknown or other
  misc_difference 506: note = a, t, c, g, unknown or other
  misc_difference 507: note = a, t, c, g, unknown or other
  misc_difference 508: note = a, t, c, g, unknown or other
  misc_difference 509: note = a, t, c, g, unknown or other
  misc_difference 510: note = a, t, c, g, unknown or other
  misc_difference 511: note = a, t, c, g, unknown or other
  misc_difference 512: note = a, t, c, g, unknown or other
  misc_difference 513: note = a, t, c, g, unknown or other
  misc_difference 514: note = a, t, c, g, unknown or other
  misc_difference 515: note = a, t, c, g, unknown or other
  misc_difference 516: note = a, t, c, g, unknown or other
  misc_difference 517: note = a, t, c, g, unknown or other
  misc_difference 518: note = a, t, c, g, unknown or other
  misc_difference 519: note = a, t, c, g, unknown or other
  misc_difference 520: note = a, t, c, g, unknown or other
  misc_difference 521: note = a, t, c, g, unknown or other
  misc_difference 522: note = a, t, c, g, unknown or other
  misc_difference 523: note = a, t, c, g, unknown or other
  misc_difference 524: note = a, t, c, g, unknown or other
  misc_difference 525: note = a, t, c, g, unknown or other
  misc_difference 526: note = a, t, c, g, unknown or other
  misc_difference 527: note = a, t, c, g, unknown or other
  misc_difference 528: note = a, t, c, g, unknown or other
  misc_difference 529: note = a, t, c, g, unknown or other
  misc_difference 530: note = a, t, c, g, unknown or other
  misc_difference 531: note = a, t, c, g, unknown or other
  misc_difference 532: note = a, t, c, g, unknown or other
  misc_difference 533: note = a, t, c, g, unknown or other
  misc_difference 534: note = a, t, c, g, unknown or other
  misc_difference 535: note = a, t, c, g, unknown or other
  misc_difference 536: note = a, t, c, g, unknown or other
  misc_difference 537: note = a, t, c, g, unknown or other
  misc_difference 538: note = a, t, c, g, unknown or other
  misc_difference 539: note = a, t, c, g, unknown or other
  misc_difference 540: note = a, t, c, g, unknown or other
  misc_difference 541: note = a, t, c, g, unknown or other
  misc_difference 542: note = a, t, c, g, unknown or other
  misc_difference 543: note = a, t, c, g, unknown or other
  misc_difference 544: note = a, t, c, g, unknown or other
  misc_difference 545: note = a, t, c, g, unknown or other
  misc_difference 546: note = a, t, c, g, unknown or other
  misc_difference 547: note = a, t, c, g, unknown or other
  misc_difference 548: note = a, t, c, g, unknown or other
  misc_difference 549: note = a, t, c, g, unknown or other
  misc_difference 550: note = a, t, c, g, unknown or other
  misc_difference 551: note = a, t, c, g, unknown or other
  misc_difference 552: note = a, t, c, g, unknown or other
  misc_difference 553: note = a, t, c, g, unknown or other
  misc_difference 554: note = a, t, c, g, unknown or other
  misc_difference 555: note = a, t, c, g, unknown or other
  misc_difference 556: note = a, t, c, g, unknown or other
  misc_difference 557: note = a, t, c, g, unknown or other
  misc_difference 558: note = a, t, c, g, unknown or other
  misc_difference 559: note = a, t, c, g, unknown or other
  misc_difference 560: note = a, t, c, g, unknown or other
  misc_difference 561: note = a, t, c, g, unknown or other
  misc_difference 562: note = a, t, c, g, unknown or other
  misc_difference 563: note = a, t, c, g, unknown or other
  misc_difference 564: note = a, t, c, g, unknown or other
  misc_difference 565: note = a, t, c, g, unknown or other
  misc_difference 566: note = a, t, c, g, unknown or other
  misc_difference 567: note = a, t, c, g, unknown or other
  misc_difference 568: note = a, t, c, g, unknown or other
  misc_difference 569: note = a, t, c, g, unknown or other
  misc_difference 570: note = a, t, c, g, unknown or other
  misc_difference 571: note = a, t, c, g, unknown or other
  misc_difference 572: note = a, t, c, g, unknown or other
  misc_difference 573: note = a, t, c, g, unknown or other
  misc_difference 574: note = a, t, c, g, unknown or other
  misc_difference 575: note = a, t, c, g, unknown or other
  misc_difference 576: note = a, t, c, g, unknown or other
  misc_difference 577: note = a, t, c, g, unknown or other
  misc_difference 578: note = a, t, c, g, unknown or other
  misc_difference 579: note = a, t, c, g, unknown or other
  misc_difference 580: note = a, t, c, g, unknown or other
  misc_difference 581: note = a, t, c, g, unknown or other
  misc_difference 582: note = a, t, c, g, unknown or other
  misc_difference 583: note = a, t, c, g, unknown or other
  misc_difference 584: note = a, t, c, g, unknown or other
  misc_difference 585: note = a, t, c, g, unknown or other
  misc_difference 586: note = a, t, c, g, unknown or other
  misc_difference 587: note = a, t, c, g, unknown or other
  misc_difference 588: note = a, t, c, g, unknown or other
  misc_difference 589: note = a, t, c, g, unknown or other
  misc_difference 590: note = a, t, c, g, unknown or other
  misc_difference 591: note = a, t, c, g, unknown or other
  misc_difference 592: note = a, t, c, g, unknown or other
  misc_difference 593: note = a, t, c, g, unknown or other
  misc_difference 594: note = a, t, c, g, unknown or other
  misc_difference 595: note = a, t, c, g, unknown or other
  misc_difference 596: note = a, t, c, g, unknown or other
  misc_difference 597: note = a, t, c, g, unknown or other
  misc_difference 598: note = a, t, c, g, unknown or other
  misc_difference 599: note = a, t, c, g, unknown or other
  misc_difference 600: note = a, t, c, g, unknown or other
  misc_difference 601: note = a, t, c, g, unknown or other
  misc_difference 602: note = a, t, c, g, unknown or other
  misc_difference 603: note = a, t, c, g, unknown or other
  misc_difference 604: note = a, t, c, g, unknown or other
  misc_difference 605: note = a, t, c, g, unknown or other
  misc_difference 606: note = a, t, c, g, unknown or other
  misc_difference 607: note = a, t, c, g, unknown or other
  misc_difference 608: note = a, t, c, g, unknown or other
  misc_difference 609: note = a, t, c, g, unknown or other
  misc_difference 610: note = a, t, c, g, unknown or other
  misc_difference 611: note = a, t, c, g, unknown or other
  misc_difference 612: note = a, t, c, g, unknown or other
  misc_difference 613: note = a, t, c, g, unknown or other
  misc_difference 614: note = a, t, c, g, unknown or other
  misc_difference 615: note = a, t, c, g, unknown or other
  misc_difference 616: note = a, t, c, g, unknown or other
  misc_difference 617: note = a, t, c, g, unknown or other
  misc_difference 618: note = a, t, c, g, unknown or other
  misc_difference 619: note = a, t, c, g, unknown or other
  misc_difference 620: note = a, t, c, g, unknown or other
  misc_difference 621: note = a, t, c, g, unknown or other
  misc_difference 622: note = a, t, c, g, unknown or other
  misc_difference 623: note = a, t, c, g, unknown or other
  misc_difference 624: note = a, t, c, g, unknown or other
  misc_difference 625: note = a, t, c, g, unknown or other
  misc_difference 626: note = a, t, c, g, unknown or other
  misc_difference 627: note = a, t, c, g, unknown or other
  misc_difference 628: note = a, t, c, g, unknown or other
  misc_difference 629: note = a, t, c, g, unknown or other
  misc_difference 630: note = a, t, c, g, unknown or other
  misc_difference 631: note = a, t, c, g, unknown or other
  misc_difference 632: note = a, t, c, g, unknown or other
  misc_difference 633: note = a, t, c, g, unknown or other
  misc_difference 634: note = a, t, c, g, unknown or other
  misc_difference 635: note = a, t, c, g, unknown or other
  misc_difference 636: note = a, t, c, g, unknown or other
  misc_difference 637: note = a, t, c, g, unknown or other
  misc_difference 638: note = a, t, c, g, unknown or other
  misc_difference 639: note = a, t, c, g, unknown or other
  misc_difference 640: note = a, t, c, g, unknown or other
  misc_difference 641: note = a, t, c, g, unknown or other
  misc_difference 642: note = a, t, c, g, unknown or other
  misc_difference 643: note = a, t, c, g, unknown or other
  misc_difference 644: note = a, t, c, g, unknown or other
  misc_difference 645: note = a, t, c, g, unknown or other
  misc_difference 646: note = a, t, c, g, unknown or other
  misc_difference 647: note = a, t, c, g, unknown or other
  misc_difference 648: note = a, t, c, g, unknown or other
  misc_difference 649: note = a, t, c, g, unknown or other
  misc_difference 650: note = a, t, c, g, unknown or other
  misc_difference 651: note = a, t, c, g, unknown or other
  misc_difference 652: note = a, t, c, g, unknown or other
  misc_difference 653: note = a, t, c, g, unknown or other
  misc_difference 654: note = a, t, c, g, unknown or other
  misc_difference 655: note = a, t, c, g, unknown or other
  misc_difference 656: note = a, t, c, g, unknown or other
  misc_difference 657: note = a, t, c, g, unknown or other
  misc_difference 658: note = a, t, c, g, unknown or other
  misc_difference 659: note = a, t, c, g, unknown or other
  misc_difference 660: note = a, t, c, g, unknown or other
  misc_difference 661: note = a, t, c, g, unknown or other
  misc_difference 662: note = a, t, c, g, unknown or other
  misc_difference 663: note = a, t, c, g, unknown or other
  misc_difference 664: note = a, t, c, g, unknown or other
  misc_difference 665: note = a, t, c, g, unknown or other
  misc_difference 666: note = a, t, c, g, unknown or other
  misc_difference 667: note = a, t, c, g, unknown or other
  misc_difference 668: note = a, t, c, g, unknown or other
  misc_difference 669: note = a, t, c, g, unknown or other
  misc_difference 670: note = a, t, c, g, unknown or other
  misc_difference 671: note = a, t, c, g, unknown or other
  misc_difference 672: note = a, t, c, g, unknown or other
  misc_difference 673: note = a, t, c, g, unknown or other
  misc_difference 674: note = a, t, c, g, unknown or other
  misc_difference 675: note = a, t, c, g, unknown or other
  misc_difference 676: note = a, t, c, g, unknown or other
  misc_difference 677: note = a, t, c, g, unknown or other
  misc_difference 678: note = a, t, c, g, unknown or other
  misc_difference 679: note = a, t, c, g, unknown or other
  misc_difference 680: note = a, t, c, g, unknown or other
  misc_difference 681: note = a, t, c, g, unknown or other
  misc_difference 682: note = a, t, c, g, unknown or other
  misc_difference 683: note = a, t, c, g, unknown or other
  misc_difference 684: note = a, t, c, g, unknown or other
  misc_difference 685: note = a, t, c, g, unknown or other
  misc_difference 686: note = a, t, c, g, unknown or other
  misc_difference 687: note = a, t, c, g, unknown or other
  misc_difference 688: note = a, t, c, g, unknown or other
  misc_difference 689: note = a, t, c, g, unknown or other
  misc_difference 690: note = a, t, c, g, unknown or other
  misc_difference 691: note = a, t, c, g, unknown or other
  misc_difference 692: note = a, t, c, g, unknown or other
  misc_difference 693: note = a, t, c, g, unknown or other
  misc_difference 694: note = a, t, c, g, unknown or other
  misc_difference 695: note = a, t, c, g, unknown or other
  misc_difference 696: note = a, t, c, g, unknown or other
  misc_difference 697: note = a, t, c, g, unknown or other
  misc_difference 698: note = a, t, c, g, unknown or other
  misc_difference 699: note = a, t, c, g, unknown or other
  misc_difference 700: note = a, t, c, g, unknown or other
  misc_difference 701: note = a, t, c, g, unknown or other
  misc_difference 702: note = a, t, c, g, unknown or other
  misc_difference 703: note = a, t, c, g, unknown or other
  misc_difference 704: note = a, t, c, g, unknown or other
  misc_difference 705: note = a, t, c, g, unknown or other
  misc_difference 706: note = a, t, c, g, unknown or other
  misc_difference 707: note = a, t, c, g, unknown or other
  misc_difference 708: note = a, t, c, g, unknown or other
  misc_difference 709: note = a, t, c, g, unknown or other
  misc_difference 710: note = a, t, c, g, unknown or other
  misc_difference 711: note = a, t, c, g, unknown or other
  misc_difference 712: note = a, t, c, g, unknown or other
  misc_difference 713: note = a, t, c, g, unknown or other
  misc_difference 714: note = a, t, c, g, unknown or other
  misc_difference 715: note = a, t, c, g, unknown or other
  misc_difference 716: note = a, t, c, g, unknown or other
  misc_difference 717: note = a, t, c, g, unknown or other
  misc_difference 718: note = a, t, c, g, unknown or other
  misc_difference 719: note = a, t, c, g, unknown or other
  misc_difference 720: note = a, t, c, g, unknown or other
  misc_difference 721: note = a, t, c, g, unknown or other
  misc_difference 722: note = a, t, c, g, unknown or other
  misc_difference 723: note = a, t, c, g, unknown or other
  misc_difference 724: note = a, t, c, g, unknown or other
  misc_difference 725: note = a, t, c, g, unknown or other
  misc_difference 726: note = a, t, c, g, unknown or other
  misc_difference 727: note = a, t, c, g, unknown or other
  misc_difference 728: note = a, t, c, g, unknown or other
  misc_difference 729: note = a, t, c, g, unknown or other
  misc_difference 730: note = a, t, c, g, unknown or other
  misc_difference 731: note = a, t, c, g, unknown or other
  misc_difference 732: note = a, t, c, g, unknown or other
  misc_difference 733: note = a, t, c, g, unknown or other
  misc_difference 734: note = a, t, c, g, unknown or other
  misc_difference 735: note = a, t, c, g, unknown or other
  misc_difference 736: note = a, t, c, g, unknown or other
  misc_difference 737: note = a, t, c, g, unknown or other
  misc_difference 738: note = a, t, c, g, unknown or other
  misc_difference 739: note = a, t, c, g, unknown or other
  misc_difference 740: note = a, t, c, g, unknown or other
  misc_difference 741: note = a, t, c, g, unknown or other
  misc_difference 742: note = a, t, c, g, unknown or other
  misc_difference 743: note = a, t, c, g, unknown or other
  misc_difference 744: note = a, t, c, g, unknown or other
  misc_difference 745: note = a, t, c, g, unknown or other
  misc_difference 746: note = a, t, c, g, unknown or other
  misc_difference 747: note = a, t, c, g, unknown or other
  misc_difference 748: note = a, t, c, g, unknown or other
  misc_difference 749: note = a, t, c, g, unknown or other
  misc_difference 750: note = a, t, c, g, unknown or other
  misc_difference 751: note = a, t, c, g, unknown or other
  misc_difference 752: note = a, t, c, g, unknown or other
  misc_difference 753: note = a, t, c, g, unknown or other
  misc_difference 754: note = a, t, c, g, unknown or other
  misc_difference 755: note = a, t, c, g, unknown or other
  misc_difference 756: note = a, t, c, g, unknown or other
  misc_difference 757: note = a, t, c, g, unknown or other
  misc_difference 758: note = a, t, c, g, unknown or other
  misc_difference 759: note = a, t, c, g, unknown or other
  misc_difference 760: note = a, t, c, g, unknown or other
  misc_difference 761: note = a, t, c, g, unknown or other
  misc_difference 762: note = a, t, c, g, unknown or other
  misc_difference 763: note = a, t, c, g, unknown or other
  misc_difference 764: note = a, t, c, g, unknown or other
  misc_difference 765: note = a, t, c, g, unknown or other
  misc_difference 766: note = a, t, c, g, unknown or other
  misc_difference 767: note = a, t, c, g, unknown or other
  misc_difference 768: note = a, t, c, g, unknown or other
  misc_difference 769: note = a, t, c, g, unknown or other
  misc_difference 770: note = a, t, c, g, unknown or other
  misc_difference 771: note = a, t, c, g, unknown or other
  misc_difference 772: note = a, t, c, g, unknown or other
  misc_difference 773: note = a, t, c, g, unknown or other
  misc_difference 774: note = a, t, c, g, unknown or other
  misc_difference 775: note = a, t, c, g, unknown or other
  misc_difference 776: note = a, t, c, g, unknown or other
  misc_difference 777: note = a, t, c, g, unknown or other
  misc_difference 778: note = a, t, c, g, unknown or other
  misc_difference 779: note = a, t, c, g, unknown or other
  misc_difference 780: note = a, t, c, g, unknown or other
  misc_difference 781: note = a, t, c, g, unknown or other
  misc_difference 782: note = a, t, c, g, unknown or other
  misc_difference 783: note = a, t, c, g, unknown or other
  misc_difference 784: note = a, t, c, g, unknown or other
  misc_difference 785: note = a, t, c, g, unknown or other
  misc_difference 786: note = a, t, c, g, unknown or other
  misc_difference 787: note = a, t, c, g, unknown or other
  misc_difference 788: note = a, t, c, g, unknown or other
  misc_difference 789: note = a, t, c, g, unknown or other
  misc_difference 790: note = a, t, c, g, unknown or other
  misc_difference 791: note = a, t, c, g, unknown or other
  misc_difference 792: note = a, t, c, g, unknown or other
  misc_difference 793: note = a, t, c, g, unknown or other
  misc_difference 794: note = a, t, c, g, unknown or other
  misc_difference 795: note = a, t, c, g, unknown or other
  misc_difference 796: note = a, t, c, g, unknown or other
  misc_difference 797: note = a, t, c, g, unknown or other
  misc_difference 798: note = a, t, c, g, unknown or other
  misc_difference 799: note = a, t, c, g, unknown or other
  misc_difference 800: note = a, t, c, g, unknown or other
  misc_difference 801: note = a, t, c, g, unknown or other
  misc_difference 802: note = a, t, c, g, unknown or other
  misc_difference 803: note = a, t, c, g, unknown or other
  misc_difference 804: note = a, t, c, g, unknown or other
  misc_difference 805: note = a, t, c, g, unknown or other
  misc_difference 806: note = a, t, c, g, unknown or other
  misc_difference 807: note = a, t, c, g, unknown or other
  misc_difference 808: note = a, t, c, g, unknown or other
  misc_difference 809: note = a, t, c, g, unknown or other
  misc_difference 810: note = a, t, c, g, unknown or other
  misc_difference 811: note = a, t, c, g, unknown or other
  misc_difference 812: note = a, t, c, g, unknown or other
  misc_difference 813: note = a, t, c, g, unknown or other
  misc_difference 814: note = a, t, c, g, unknown or other
  misc_difference 815: note = a, t, c, g, unknown or other
  misc_difference 816: note = a, t, c, g, unknown or other
  misc_difference 817: note = a, t, c, g, unknown or other
  misc_difference 818: note = a, t, c, g, unknown or other
  misc_difference 819: note = a, t, c, g, unknown or other
  misc_difference 820: note = a, t, c, g, unknown or other
  misc_difference 821: note = a, t, c, g, unknown or other
  misc_difference 822: note = a, t, c, g, unknown or other
  misc_difference 823: note = a, t, c, g, unknown or other
  misc_difference 824: note = a, t, c, g, unknown or other
  misc_difference 825: note = a, t, c, g, unknown or other
  misc_difference 826: note = a, t, c, g, unknown or other
  misc_difference 827: note = a, t, c, g, unknown or other
  misc_difference 828: note = a, t, c, g, unknown or other
  misc_difference 829: note = a, t, c, g, unknown or other
  misc_difference 830: note = a, t, c, g, unknown or other
  misc_difference 831: note = a, t, c, g, unknown or other
  misc_difference 832: note = a, t, c, g, unknown or other
  misc_difference 833: note = a, t, c, g, unknown or other
  misc_difference 834: note = a, t, c, g, unknown or other
  misc_difference 835: note = a, t, c, g, unknown or other
  misc_difference 836: note = a, t, c, g, unknown or other
  misc_difference 837: note = a, t, c, g, unknown or other
  misc_difference 838: note = a, t, c, g, unknown or other
  misc_difference 839: note = a, t, c, g, unknown or other
  misc_difference 840: note = a, t, c, g, unknown or other
  misc_difference 841: note = a, t, c, g, unknown or other
  misc_difference 842: note = a, t, c, g, unknown or other
  misc_difference 843: note = a, t, c, g, unknown or other
  misc_difference 844: note = a, t, c, g, unknown or other
  misc_difference 845: note = a, t, c, g, unknown or other
  misc_difference 846: note = a, t, c, g, unknown or other
  misc_difference 847: note = a, t, c, g, unknown or other
  misc_difference 848: note = a, t, c, g, unknown or other
  misc_difference 849: note = a, t, c, g, unknown or other
  misc_difference 850: note = a, t, c, g, unknown or other
  misc_difference 851: note = a, t, c, g, unknown or other
  misc_difference 852: note = a, t, c, g, unknown or other
  misc_difference 853: note = a, t, c, g, unknown or other
  misc_difference 854: note = a, t, c, g, unknown or other
  misc_difference 855: note = a, t, c, g, unknown or other
  misc_difference 856: note = a, t, c, g, unknown or other
  misc_difference 857: note = a, t, c, g, unknown or other
  misc_difference 858: note = a, t, c, g, unknown or other
  misc_difference 859: note = a, t, c, g, unknown or other
  misc_difference 860: note = a, t, c, g, unknown or other
  misc_difference 861: note = a, t, c, g, unknown or other
  misc_difference 862: note = a, t, c, g, unknown or other
  misc_difference 863: note = a, t, c, g, unknown or other
  misc_difference 864: note = a, t, c, g, unknown or other
  misc_difference 865: note = a, t, c, g, unknown or other
  misc_difference 866: note = a, t, c, g, unknown or other
  misc_difference 867: note = a, t, c, g, unknown or other
  misc_difference 868: note = a, t, c, g, unknown or other
  misc_difference 869: note = a, t, c, g, unknown or other
  misc_difference 870: note = a, t, c, g, unknown or other
  misc_difference 871: note = a, t, c, g, unknown or other
  misc_difference 872: note = a, t, c, g, unknown or other
  misc_difference 873: note = a, t, c, g, unknown or other
  misc_difference 874: note = a, t, c, g, unknown or other
  misc_difference 875: note = a, t, c, g, unknown or other
  misc_difference 876: note = a, t, c, g, unknown or other
  misc_difference 877: note = a, t, c, g, unknown or other
  misc_difference 878: note = a, t, c, g, unknown or other
  misc_difference 879: note = a, t, c, g, unknown or other
  misc_difference 880: note = a, t, c, g, unknown or other
  misc_difference 881: note = a, t, c, g, unknown or other
  misc_difference 882: note = a, t, c, g, unknown or other
  misc_difference 883: note = a, t, c, g, unknown or other
  misc_difference 884: note = a, t, c, g, unknown or other
  misc_difference 885: note = a, t, c, g, unknown or other
  misc_difference 886: note = a, t, c, g, unknown or other
  misc_difference 887: note = a, t, c, g, unknown or other
  misc_difference 888: note = a, t, c, g, unknown or other
  misc_difference 889: note = a, t, c, g, unknown or other
  misc_difference 890: note = a, t, c, g, unknown or other
  misc_difference 891: note = a, t, c, g, unknown or other
  misc_difference 892: note = a, t, c, g, unknown or other
  misc_difference 893: note = a, t, c, g, unknown or other
  misc_difference 894: note = a, t, c, g, unknown or other
  misc_difference 895: note = a, t, c, g, unknown or other
  misc_difference 896: note = a, t, c, g, unknown or other
  misc_difference 897: note = a, t, c, g, unknown or other
  misc_difference 898: note = a, t, c, g, unknown or other
  misc_difference 899: note = a, t, c, g, unknown or other
  misc_difference 900: note = a, t, c, g, unknown or other
  misc_difference 901: note = a, t, c, g, unknown or other
  misc_difference 902: note = a, t, c, g, unknown or other
  misc_difference 903: note = a, t, c, g, unknown or other
  misc_difference 904: note = a, t, c, g, unknown or other
  misc_difference 905: note = a, t, c, g, unknown or other
  misc_difference 906: note = a, t, c, g, unknown or other
  misc_difference 907: note = a, t, c, g, unknown or other
  misc_difference 908: note = a, t, c, g, unknown or other
  misc_difference 909: note = a, t, c, g, unknown or other
  misc_difference 910: note = a, t, c, g, unknown or other
  misc_difference 911: note = a, t, c, g, unknown or other
  misc_difference 912: note = a, t, c, g, unknown or other
  misc_difference 913: note = a, t, c, g, unknown or other
  misc_difference 914: note = a, t, c, g, unknown or other
  misc_difference 915: note = a, t, c, g, unknown or other
  misc_difference 916: note = a, t, c, g, unknown or other
  misc_difference 917: note = a, t, c, g, unknown or other
  misc_difference 918: note = a, t, c, g, unknown or other
  misc_difference 919: note = a, t, c, g, unknown or other
  misc_difference 920: note = a, t, c, g, unknown or other
  misc_difference 921: note = a, t, c, g, unknown or other
  misc_difference 922: note = a, t, c, g, unknown or other
  misc_difference 923: note = a, t, c, g, unknown or other
  misc_difference 924: note = a, t, c, g, unknown or other
  misc_difference 925: note = a, t, c, g, unknown or other
  misc_difference 926: note = a, t, c, g, unknown or other
  misc_difference 927: note = a, t, c, g, unknown or other
  misc_difference 928: note = a, t, c, g, unknown or other
  misc_difference 929: note = a, t, c, g, unknown or other
  misc_difference 930: note = a, t, c, g, unknown or other
  misc_difference 931: note = a, t, c, g, unknown or other
  misc_difference 932: note = a, t, c, g, unknown or other
  misc_difference 933: note = a, t, c, g, unknown or other
  misc_difference 934: note = a, t, c, g, unknown or other
  misc_difference 935: note = a, t, c, g, unknown or other
  misc_difference 936: note = a, t, c, g, unknown or other
  misc_difference 937: note = a, t, c, g, unknown or other
  misc_difference 938: note = a, t, c, g, unknown or other
  misc_difference 939: note = a, t, c, g, unknown or other
  misc_difference 940: note = a, t, c, g, unknown or other
  misc_difference 941: note = a, t, c, g, unknown or other
  misc_difference 942: note = a, t, c, g, unknown or other
  misc_difference 943: note = a, t, c, g, unknown or other
  misc_difference 944: note = a, t, c, g, unknown or other
  misc_difference 945: note = a, t, c, g, unknown or other
  misc_difference 946: note = a, t, c, g, unknown or other
  misc_difference 947: note = a, t, c, g, unknown or other
  misc_difference 948: note = a, t, c, g, unknown or other
  misc_difference 949: note = a, t, c, g, unknown or other
  misc_difference 950: note = a, t, c, g, unknown or other
  misc_difference 951: note = a, t, c, g, unknown or other
  misc_difference 952: note = a, t, c, g, unknown or other
  misc_difference 953: note = a, t, c, g, unknown or other
  misc_difference 954: note = a, t, c, g, unknown or other
  misc_difference 955: note = a, t, c, g, unknown or other
  misc_difference 956: note = a, t, c, g, unknown or other
  misc_difference 957: note = a, t, c, g, unknown or other
  misc_difference 958: note = a, t, c, g, unknown or other
  misc_difference 959: note = a, t, c, g, unknown or other
  misc_difference 960: note = a, t, c, g, unknown or other
  misc_difference 961: note = a, t, c, g, unknown or other
  misc_difference 962: note = a, t, c, g, unknown or other
  misc_difference 963: note = a, t, c, g, unknown or other
  misc_difference 964: note = a, t, c, g, unknown or other
  misc_difference 965: note = a, t, c, g, unknown or other
  misc_difference 966: note = a, t, c, g, unknown or other
  misc_difference 967: note = a, t, c, g, unknown or other
  misc_difference 968: note = a, t, c, g, unknown or other
  misc_difference 969: note = a, t, c, g, unknown or other
  misc_difference 970: note = a, t, c, g, unknown or other
  misc_difference 971: note = a, t, c, g, unknown or other
  misc_difference 972: note = a, t, c, g, unknown or other
  misc_difference 973: note = a, t, c, g, unknown or other
  misc_difference 974: note = a, t, c, g, unknown or other
  misc_difference 975: note = a, t, c, g, unknown or other
  misc_difference 976: note = a, t, c, g, unknown or other
  misc_difference 977: note = a, t, c, g, unknown or other
  misc_difference 978: note = a, t, c, g, unknown or other
  misc_difference 979: note = a, t, c, g, unknown or other
  misc_difference 980: note = a, t, c, g, unknown or other
  misc_difference 981: note = a, t, c, g, unknown or other
  misc_difference 982: note = a, t, c, g, unknown or other
  misc_difference 983: note = a, t, c, g, unknown or other
  misc_difference 984: note = a, t, c, g, unknown or other
  misc_difference 985: note = a, t, c, g, unknown or other
  misc_difference 986: note = a, t, c, g, unknown or other
  misc_difference 987: note = a, t, c, g, unknown or other
  misc_difference 988: note = a, t, c, g, unknown or other
  misc_difference 989: note = a, t, c, g, unknown or other
  misc_difference 990: note = a, t, c, g, unknown or other
  misc_difference 991: note = a, t, c, g, unknown or other
  misc_difference 992: note = a, t, c, g, unknown or other
  misc_difference 993: note = a, t, c, g, unknown or other
  misc_difference 994: note = a, t, c, g, unknown or other
  misc_difference 995: note = a, t, c, g, unknown or other
  misc_difference 996: note = a, t, c, g, unknown or other
  misc_difference 997: note = a, t, c, g, unknown or other
  misc_difference 998: note = a, t, c, g, unknown or other
  misc_difference 999: note = a, t, c, g, unknown or other
  misc_difference 1000: note = a, t, c, g, unknown or other
  misc_difference 1001..1027: note = a, t, c, g, unknown or other
  modified_base 1052: mod_base = OTHER; note = hydroxy thymidine
gggctggcgaccttgacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtactgactgtagggctggcgacct

SEQ ID NO: 3 - DNA, 1038 bp, synthetic construct
  source 1..1038: mol_type = other DNA
  modified_base 1: mod_base = OTHER; note = Phosphate adenosine
  misc_difference 12: note = a, t, c, g, unknown or other
  misc_difference 13: note = a, t, c, g, unknown or other
  misc_difference 14: note = a, t, c, g, unknown or other
  misc_difference 15: note = a, t, c, g, unknown or other
  misc_difference 16: note = a, t, c, g, unknown or other
  misc_difference 17: note = a, t, c, g, unknown or other
  misc_difference 18: note = a, t, c, g, unknown or other
  misc_difference 19: note = a, t, c, g, unknown or other
  misc_difference 20: note = a, t, c, g, unknown or other
  misc_difference 21: note = a, t, c, g, unknown or other
  misc_difference 22: note = a, t, c, g, unknown or other
  misc_difference 23: note = a, t, c, g, unknown or other
  misc_difference 24: note = a, t, c, g, unknown or other
  misc_difference 25: note = a, t, c, g, unknown or other
  misc_difference 26: note = a, t, c, g, unknown or other
  misc_difference 27: note = a, t, c, g, unknown or other
  misc_difference 28: note = a, t, c, g, unknown or other
  misc_difference 29: note = a, t, c, g, unknown or other
  misc_difference 30: note = a, t, c, g, unknown or other
  misc_difference 31: note = a, t, c, g, unknown or other
  misc_difference 32: note = a, t, c, g, unknown or other
  misc_difference 33: note = a, t, c, g, unknown or other
  misc_difference 34: note = a, t, c, g, unknown or other
  misc_difference 35: note = a, t, c, g, unknown or other
  misc_difference 36: note = a, t, c, g, unknown or other
  misc_difference 37: note = a, t, c, g, unknown or other
  misc_difference 38: note = a, t, c, g, unknown or other
  misc_difference 39: note = a, t, c, g, unknown or other
  misc_difference 40: note = a, t, c, g, unknown or other
  misc_difference 41: note = a, t, c, g, unknown or other
  misc_difference 42: note = a, t, c, g, unknown or other
  misc_difference 43: note = a, t, c, g, unknown or other
  misc_difference 44: note = a, t, c, g, unknown or other
  misc_difference 45: note = a, t, c, g, unknown or other
  misc_difference 46: note = a, t, c, g, unknown or other
  misc_difference 47: note = a, t, c, g, unknown or other
  misc_difference 48: note = a, t, c, g, unknown or other
  misc_difference 49: note = a, t, c, g, unknown or other
  misc_difference 50: note = a, t, c, g, unknown or other
  misc_difference 51: note = a, t, c, g, unknown or other
  misc_difference 52: note = a, t, c, g, unknown or other
  misc_difference 53: note = a, t, c, g, unknown or other
  misc_difference 54: note = a, t, c, g, unknown or other
  misc_difference 55: note = a, t, c, g, unknown or other
  misc_difference 56: note = a, t, c, g, unknown or other
  misc_difference 57: note = a, t, c, g, unknown or other
  misc_difference 58: note = a, t, c, g, unknown or other
  misc_difference 59: note = a, t, c, g, unknown or other
  misc_difference 60: note = a, t, c, g, unknown or other
  misc_difference 61: note = a, t, c, g, unknown or other
  misc_difference 62: note = a, t, c, g, unknown or other
  misc_difference 63: note = a, t, c, g, unknown or other
  misc_difference 64: note = a, t, c, g, unknown or other
  misc_difference 65: note = a, t, c, g, unknown or other
  misc_difference 66: note = a, t, c, g, unknown or other
  misc_difference 67: note = a, t, c, g, unknown or other
  misc_difference 68: note = a, t, c, g, unknown or other
  misc_difference 69: note = a, t, c, g, unknown or other
  misc_difference 70: note = a, t, c, g, unknown or other
  misc_difference 71: note = a, t, c, g, unknown or other
  misc_difference 72: note = a, t, c, g, unknown or other
  misc_difference 73: note = a, t, c, g, unknown or other
  misc_difference 74: note = a, t, c, g, unknown or other
  misc_difference 75: note = a, t, c, g, unknown or other
  misc_difference 76: note = a, t, c, g, unknown or other
  misc_difference 77: note = a, t, c, g, unknown or other
  misc_difference 78: note = a, t, c, g, unknown or other
  misc_difference 79: note = a, t, c, g, unknown or other
  misc_difference 80: note = a, t, c, g, unknown or other
  misc_difference 81: note = a, t, c, g, unknown or other
  misc_difference 82: note = a, t, c, g, unknown or other
  misc_difference 83: note = a, t, c, g, unknown or other
  misc_difference 84: note = a, t, c, g, unknown or other
  misc_difference 85: note = a, t, c, g, unknown or other
  misc_difference 86: note = a, t, c, g, unknown or other
  misc_difference 87: note = a, t, c, g, unknown or other
  misc_difference 88: note = a, t, c, g, unknown or other
  misc_difference 89: note = a, t, c, g, unknown or other
  misc_difference 90: note = a, t, c, g, unknown or other
  misc_difference 91: note = a, t, c, g, unknown or other
  misc_difference 92: note = a, t, c, g, unknown or other
  misc_difference 93: note = a, t, c, g, unknown or other
  misc_difference 94: note = a, t, c, g, unknown or other
  misc_difference 95: note = a, t, c, g, unknown or other
  misc_difference 96: note = a, t, c, g, unknown or other
  misc_difference 97: note = a, t, c, g, unknown or other
  misc_difference 98: note = a, t, c, g, unknown or other
  misc_difference 99: note = a, t, c, g, unknown or other
  misc_difference 100: note = a, t, c, g, unknown or other
  misc_difference 101: note = a, t, c, g, unknown or other
  misc_difference 102: note = a, t, c, g, unknown or other
  misc_difference 103: note = a, t, c, g, unknown or other
  misc_difference 104: note = a, t, c, g, unknown or other
  misc_difference 105: note = a, t, c, g, unknown or other
  misc_difference 106: note = a, t, c, g, unknown or other
  misc_difference 107: note = a, t, c, g, unknown or other
  misc_difference 108: note = a, t, c, g, unknown or other
  misc_difference 109: note = a, t, c, g, unknown or other
  misc_difference 110: note = a, t, c, g, unknown or other
  misc_difference 111: note = a, t, c, g, unknown or other
  misc_difference 112: note = a, t, c, g, unknown or other
  misc_difference 113: note = a, t, c, g, unknown or other
  misc_difference 114: note = a, t, c, g, unknown or other
  misc_difference 115: note = a, t, c, g, unknown or other
  misc_difference 116: note = a, t, c, g, unknown or other
  misc_difference 117: note = a, t, c, g, unknown or other
  misc_difference 118: note = a, t, c, g, unknown or other
  misc_difference 119: note = a, t, c, g, unknown or other
  misc_difference 120: note = a, t, c, g, unknown or other
  misc_difference 121: note = a, t, c, g, unknown or other
  misc_difference 122: note = a, t, c, g, unknown or other
  misc_difference 123: note = a, t, c, g, unknown or other
  misc_difference 124: note = a, t, c, g, unknown or other
  misc_difference 125: note = a, t, c, g, unknown or other
  misc_difference 126: note = a, t, c, g, unknown or other
  misc_difference 127: note = a, t, c, g, unknown or other
  misc_difference 128: note = a, t, c, g, unknown or other
  misc_difference 129: note = a, t, c, g, unknown or other
  misc_difference 130: note = a, t, c, g, unknown or other
  misc_difference 131: note = a, t, c, g, unknown or other
  misc_difference 132: note = a, t, c, g, unknown or other
  misc_difference 133: note = a, t, c, g, unknown or other
  misc_difference 134: note = a, t, c, g, unknown or other
  misc_difference 135: note = a, t, c, g, unknown or other
  misc_difference 136: note = a, t, c, g, unknown or other
  misc_difference 137: note = a, t, c, g, unknown or other
  misc_difference 138: note = a, t, c, g, unknown or other
  misc_difference 139: note = a, t, c, g, unknown or other
  misc_difference 140: note = a, t, c, g, unknown or other
  misc_difference 141: note = a, t, c, g, unknown or other
  misc_difference 142: note = a, t, c, g, unknown or other
  misc_difference 143: note = a, t, c, g, unknown or other
  misc_difference 144: note = a, t, c, g, unknown or other
  misc_difference 145: note = a, t, c, g, unknown or other
  misc_difference 146: note = a, t, c, g, unknown or other
  misc_difference 147: note = a, t, c, g, unknown or other
  misc_difference 148: note = a, t, c, g, unknown or other
  misc_difference 149: note = a, t, c, g, unknown or other
  misc_difference 150: note = a, t, c, g, unknown or other
  misc_difference 151: note = a, t, c, g, unknown or other
  misc_difference 152: note = a, t, c, g, unknown or other
  misc_difference 153: note = a, t, c, g, unknown or other
  misc_difference 154: note = a, t, c, g, unknown or other
  misc_difference 155: note = a, t, c, g, unknown or other
  misc_difference 156: note = a, t, c, g, unknown or other
  misc_difference 157: note = a, t, c, g, unknown or other
  misc_difference 158: note = a, t, c, g, unknown or other
  misc_difference 159: note = a, t, c, g, unknown or other
  misc_difference 160: note = a, t, c, g, unknown or other
  misc_difference 161: note = a, t, c, g, unknown or other
  misc_difference 162: note = a, t, c, g, unknown or other
  misc_difference 163: note = a, t, c, g, unknown or other
  misc_difference 164: note = a, t, c, g, unknown or other
  misc_difference 165: note = a, t, c, g, unknown or other
  misc_difference 166: note = a, t, c, g, unknown or other
  misc_difference 167: note = a, t, c, g, unknown or other
  misc_difference 168: note = a, t, c, g, unknown or other
  misc_difference 169: note = a, t, c, g, unknown or other
  misc_difference 170: note = a, t, c, g, unknown or other
  misc_difference 171: note = a, t, c, g, unknown or other
  misc_difference 172: note = a, t, c, g, unknown or other
  misc_difference 173: note = a, t, c, g, unknown or other
  misc_difference 174: note = a, t, c, g, unknown or other
  misc_difference 175: note = a, t, c, g, unknown or other
  misc_difference 176: note = a, t, c, g, unknown or other
  misc_difference 177: note = a, t, c, g, unknown or other
  misc_difference 178: note = a, t, c, g, unknown or other
  misc_difference 179: note = a, t, c, g, unknown or other
  misc_difference 180: note = a, t, c, g, unknown or other
  misc_difference 181: note = a, t, c, g, unknown or other
  misc_difference 182: note = a, t, c, g, unknown or other
  misc_difference 183: note = a, t, c, g, unknown or other
  misc_difference 184: note = a, t, c, g, unknown or other
  misc_difference 185: note = a, t, c, g, unknown or other
  misc_difference 186: note = a, t, c, g, unknown or other
  misc_difference 187: note = a, t, c, g, unknown or other
  misc_difference 188: note = a, t, c, g, unknown or other
  misc_difference 189: note = a, t, c, g, unknown or other
  misc_difference 190: note = a, t, c, g, unknown or other
  misc_difference 191: note = a, t, c, g, unknown or other
  misc_difference 192: note = a, t, c, g, unknown or other
  misc_difference 193: note = a, t, c, g, unknown or other
  misc_difference 194: note = a, t, c, g, unknown or other
  misc_difference 195: note = a, t, c, g, unknown or other
  misc_difference 196: note = a, t, c, g, unknown or other
  misc_difference 197: note = a, t, c, g, unknown or other
  misc_difference 198: note = a, t, c, g, unknown or other
  misc_difference 199: note = a, t, c, g, unknown or other
  misc_difference 200: note = a, t, c, g, unknown or other
  misc_difference 201: note = a, t, c, g, unknown or other
  misc_difference 202: note = a, t, c, g, unknown or other
  misc_difference 203: note = a, t, c, g, unknown or other
  misc_difference 204: note = a, t, c, g, unknown or other
  misc_difference 205: note = a, t, c, g, unknown or other
  misc_difference 206: note = a, t, c, g, unknown or other
  misc_difference 207: note = a, t, c, g, unknown or other
  misc_difference 208: note = a, t, c, g, unknown or other
  misc_difference 209: note = a, t, c, g, unknown or other
  misc_difference 210: note = a, t, c, g, unknown or other
  misc_difference 211: note = a, t, c, g, unknown or other
  misc_difference 212: note = a, t, c, g, unknown or other
  misc_difference 213: note = a, t, c, g, unknown or other
  misc_difference 214: note = a, t, c, g, unknown or other
  misc_difference 215: note = a, t, c, g, unknown or other
  misc_difference 216: note = a, t, c, g, unknown or other
  misc_difference 217: note = a, t, c, g, unknown or other
  misc_difference 218: note = a, t, c, g, unknown or other
  misc_difference 219: note = a, t, c, g, unknown or other
  misc_difference 220: note = a, t, c, g, unknown or other
  misc_difference 221: note = a, t, c, g, unknown or other
  misc_difference 222: note = a, t, c, g, unknown or other
  misc_difference 223: note = a, t, c, g, unknown or other
  misc_difference 224: note = a, t, c, g, unknown or other
  misc_difference 225: note = a, t, c, g, unknown or other
  misc_difference 226: note = a, t, c, g, unknown or other
  misc_difference 227: note = a, t, c, g, unknown or other
  misc_difference 228: note = a, t, c, g, unknown or other
  misc_difference 229: note = a, t, c, g, unknown or other
  misc_difference 230: note = a, t, c, g, unknown or other
  misc_difference 231: note = a, t, c, g, unknown or other
  misc_difference 232: note = a, t, c, g, unknown or other
  misc_difference 233: note = a, t, c, g, unknown or other
  misc_difference 234: note = a, t, c, g, unknown or other
  misc_difference 235: note = a, t, c, g, unknown or other
  misc_difference 236: note = a, t, c, g, unknown or other
  misc_difference 237: note = a, t, c, g, unknown or other
  misc_difference 238: note = a, t, c, g, unknown or other
  misc_difference 239: note = a, t, c, g, unknown or other
  misc_difference 240: note = a, t, c, g, unknown or other
  misc_difference 241: note = a, t, c, g, unknown or other
  misc_difference 242: note = a, t, c, g, unknown or other
  misc_difference 243: note = a, t, c, g, unknown or other
  misc_difference 244: note = a, t, c, g, unknown or other
  misc_difference 245: note = a, t, c, g, unknown or other
  misc_difference 246: note = a, t, c, g, unknown or other
  misc_difference 247: note = a, t, c, g, unknown or other
  misc_difference 248: note = a, t, c, g, unknown or other
  misc_difference 249: note = a, t, c, g, unknown or other
  misc_difference 250: note = a, t, c, g, unknown or other
  misc_difference 251: note = a, t, c, g, unknown or other
  misc_difference 252: note = a, t, c, g, unknown or other
  misc_difference 253: note = a, t, c, g, unknown or other
  misc_difference 254: note = a, t, c, g, unknown or other
  misc_difference 255: note = a, t, c, g, unknown or other
  misc_difference 256: note = a, t, c, g, unknown or other
  misc_difference 257: note = a, t, c, g, unknown or other
  misc_difference 258: note = a, t, c, g, unknown or other
  misc_difference 259: note = a, t, c, g, unknown or other
  misc_difference 260: note = a, t, c, g, unknown or other
  misc_difference 261: note = a, t, c, g, unknown or other
  misc_difference 262: note = a, t, c, g, unknown or other
  misc_difference 263: note = a, t, c, g, unknown or other
  misc_difference 264: note = a, t, c, g, unknown or other
  misc_difference 265: note = a, t, c, g, unknown or other
  misc_difference 266: note = a, t, c, g, unknown or other
  misc_difference 267: note = a, t, c, g, unknown or other
  misc_difference 268: note = a, t, c, g, unknown or other
  misc_difference 269: note = a, t, c, g, unknown or other
  misc_difference 270: note = a, t, c, g, unknown or other
  misc_difference 271: note = a, t, c, g, unknown or other
  misc_difference 272: note = a, t, c, g, unknown or other
  misc_difference 273: note = a, t, c, g, unknown or other
  misc_difference 274: note = a, t, c, g, unknown or other
  misc_difference 275: note = a, t, c, g, unknown or other
  misc_difference 276: note = a, t, c, g, unknown or other
  misc_difference 277: note = a, t, c, g, unknown or other
  misc_difference 278: note = a, t, c, g, unknown or other
  misc_difference 279: note = a, t, c, g, unknown or other
  misc_difference 280: note = a, t, c, g, unknown or other
  misc_difference 281: note = a, t, c, g, unknown or other
  misc_difference 282: note = a, t, c, g, unknown or other
  misc_difference 283: note = a, t, c, g, unknown or other
  misc_difference 284: note = a, t, c, g, unknown or other
  misc_difference 285: note = a, t, c, g, unknown or other
  misc_difference 286: note = a, t, c, g, unknown or other
  misc_difference 287: note = a, t, c, g, unknown or other
  misc_difference 288: note = a, t, c, g, unknown or other
  misc_difference 289: note = a, t, c, g, unknown or other
  misc_difference 290: note = a, t, c, g, unknown or other
  misc_difference 291: note = a, t, c, g, unknown or other
  misc_difference 292: note = a, t, c, g, unknown or other
  misc_difference 293: note = a, t, c, g, unknown or other
  misc_difference 294: note = a, t, c, g, unknown or other
  misc_difference 295: note = a, t, c, g, unknown or other
  misc_difference 296: note = a, t, c, g, unknown or other
  misc_difference 297: note = a, t, c, g, unknown or other
  misc_difference 298: note = a, t, c, g, unknown or other
  misc_difference 299: note = a, t, c, g, unknown or other
  misc_difference 300: note = a, t, c, g, unknown or other
  misc_difference 301: note = a, t, c, g, unknown or other
  misc_difference 302: note = a, t, c, g, unknown or other
  misc_difference 303: note = a, t, c, g, unknown or other
  misc_difference 304: note = a, t, c, g, unknown or other
  misc_difference 305: note = a, t, c, g, unknown or other
  misc_difference 306: note = a, t, c, g, unknown or other
  misc_difference 307: note = a, t, c, g, unknown or other
  misc_difference 308: note = a, t, c, g, unknown or other
  misc_difference 309: note = a, t, c, g, unknown or other
  misc_difference 310: note = a, t, c, g, unknown or other
  misc_difference 311: note = a, t, c, g, unknown or other
  misc_difference 312: note = a, t, c, g, unknown or other
  misc_difference 313: note = a, t, c, g, unknown or other
  misc_difference 314: note = a, t, c, g, unknown or other
  misc_difference 315: note = a, t, c, g, unknown or other
  misc_difference 316: note = a, t, c, g, unknown or other
  misc_difference 317: note = a, t, c, g, unknown or other
  misc_difference 318: note = a, t, c, g, unknown or other
  misc_difference 319: note = a, t, c, g, unknown or other
  misc_difference 320: note = a, t, c, g, unknown or other
  misc_difference 321: note = a, t, c, g, unknown or other
  misc_difference 322: note = a, t, c, g, unknown or other
  misc_difference 323: note = a, t, c, g, unknown or other
  misc_difference 324: note = a, t, c, g, unknown or other
  misc_difference 325: note = a, t, c, g, unknown or other
  misc_difference 326: note = a, t, c, g, unknown or other
  misc_difference 327: note = a, t, c, g, unknown or other
  misc_difference 328: note = a, t, c, g, unknown or other
  misc_difference 329: note = a, t, c, g, unknown or other
  misc_difference 330: note = a, t, c, g, unknown or other
  misc_difference 331: note = a, t, c, g, unknown or other
  misc_difference 332: note = a, t, c, g, unknown or other
  misc_difference 333: note = a, t, c, g, unknown or other
  misc_difference 334: note = a, t, c, g, unknown or other
  misc_difference 335: note = a, t, c, g, unknown or other
  misc_difference 336: note = a, t, c, g, unknown or other
  misc_difference 337: note = a, t, c, g, unknown or other
  misc_difference 338: note = a, t, c, g, unknown or other
  misc_difference 339: note = a, t, c, g, unknown or other
  misc_difference 340: note = a, t, c, g, unknown or other
  misc_difference 341: note = a, t, c, g, unknown or other
  misc_difference 342: note = a, t, c, g, unknown or other
  misc_difference 343: note = a, t, c, g, unknown or other
  misc_difference 344: note = a, t, c, g, unknown or other
  misc_difference 345: note = a, t, c, g, unknown or other
  misc_difference 346: note = a, t, c, g, unknown or other
  misc_difference 347: note = a, t, c, g, unknown or other
  misc_difference 348: note = a, t, c, g, unknown or other
  misc_difference 349: note = a, t, c, g, unknown or other
  misc_difference 350: note = a, t, c, g, unknown or other
  misc_difference 351: note = a, t, c, g, unknown or other
  misc_difference 352: note = a, t, c, g, unknown or other
  misc_difference 353: note = a, t, c, g, unknown or other
  misc_difference 354: note = a, t, c, g, unknown or other
  misc_difference 355: note = a, t, c, g, unknown or other
  misc_difference 356: note = a, t, c, g, unknown or other
  misc_difference 357: note = a, t, c, g, unknown or other
  misc_difference 358: note = a, t, c, g, unknown or other
  misc_difference 359: note = a, t, c, g, unknown or other
  misc_difference 360: note = a, t, c, g, unknown or other
  misc_difference 361: note = a, t, c, g, unknown or other
  misc_difference 362: note = a, t, c, g, unknown or other
  misc_difference 363: note = a, t, c, g, unknown or other
  misc_difference 364: note = a, t, c, g, unknown or other
  misc_difference 365: note = a, t, c, g, unknown or other
  misc_difference 366: note = a, t, c, g, unknown or other
  misc_difference 367: note = a, t, c, g, unknown or other
  misc_difference 368: note = a, t, c, g, unknown or other
  misc_difference 369: note = a, t, c, g, unknown or other
  misc_difference 370: note = a, t, c, g, unknown or other
  misc_difference 371: note = a, t, c, g, unknown or other
  misc_difference 372: note = a, t, c, g, unknown or other
  misc_difference 373: note = a, t, c, g, unknown or other
  misc_difference 374: note = a, t, c, g, unknown or other
  misc_difference 375: note = a, t, c, g, unknown or other
  misc_difference 376: note = a, t, c, g, unknown or other
  misc_difference 377: note = a, t, c, g, unknown or other
  misc_difference 378: note = a, t, c, g, unknown or other
  misc_difference 379: note = a, t, c, g, unknown or other
  misc_difference 380: note = a, t, c, g, unknown or other
  misc_difference 381: note = a, t, c, g, unknown or other
  misc_difference 382: note = a, t, c, g, unknown or other
  misc_difference 383: note = a, t, c, g, unknown or other
  misc_difference 384: note = a, t, c, g, unknown or other
  misc_difference 385: note = a, t, c, g, unknown or other
  misc_difference 386: note = a, t, c, g, unknown or other
  misc_difference 387: note = a, t, c, g, unknown or other
  misc_difference 388: note = a, t, c, g, unknown or other
  misc_difference 389: note = a, t, c, g, unknown or other
  misc_difference 390: note = a, t, c, g, unknown or other
  misc_difference 391: note = a, t, c, g, unknown or other
  misc_difference 392: note = a, t, c, g, unknown or other
  misc_difference 393: note = a, t, c, g, unknown or other
  misc_difference 394: note = a, t, c, g, unknown or other
  misc_difference 395: note = a, t, c, g, unknown or other
  misc_difference 396: note = a, t, c, g, unknown or other
  misc_difference 397: note = a, t, c, g, unknown or other
  misc_difference 398: note = a, t, c, g, unknown or other
  misc_difference 399: note = a, t, c, g, unknown or other
  misc_difference 400: note = a, t, c, g, unknown or other
  misc_difference 401: note = a, t, c, g, unknown or other
  misc_difference 402: note = a, t, c, g, unknown or other
  misc_difference 403: note = a, t, c, g, unknown or other
  misc_difference 404: note = a, t, c, g, unknown or other
  misc_difference 405: note = a, t, c, g, unknown or other
  misc_difference 406: note = a, t, c, g, unknown or other
  misc_difference 407: note = a, t, c, g, unknown or other
  misc_difference 408: note = a, t, c, g, unknown or other
  misc_difference 409: note = a, t, c, g, unknown or other
  misc_difference 410: note = a, t, c, g, unknown or other
  misc_difference 411: note = a, t, c, g, unknown or other
  misc_difference 412: note = a, t, c, g, unknown or other
  misc_difference 413: note = a, t, c, g, unknown or other
  misc_difference 414: note = a, t, c, g, unknown or other
  misc_difference 415: note = a, t, c, g, unknown or other
  misc_difference 416: note = a, t, c, g, unknown or other
  misc_difference 417: note = a, t, c, g, unknown or other
  misc_difference 418: note = a, t, c, g, unknown or other
  misc_difference 419: note = a, t, c, g, unknown or other
  misc_difference 420: note = a, t, c, g, unknown or other
  misc_difference 421: note = a, t, c, g, unknown or other
  misc_difference 422: note = a, t, c, g, unknown or other
  misc_difference 423: note = a, t, c, g, unknown or other
  misc_difference 424: note = a, t, c, g, unknown or other
  misc_difference 425: note = a, t, c, g, unknown or other
  misc_difference 426: note = a, t, c, g, unknown or other
  misc_difference 427: note = a, t, c, g, unknown or other
  misc_difference 428: note = a, t, c, g, unknown or other
  misc_difference 429: note = a, t, c, g, unknown or other
  misc_difference 430: note = a, t, c, g, unknown or other
  misc_difference 431: note = a, t, c, g, unknown or other
  misc_difference 432: note = a, t, c, g, unknown or other
  misc_difference 433: note = a, t, c, g, unknown or other
  misc_difference 434: note = a, t, c, g, unknown or other
  misc_difference 435: note = a, t, c, g, unknown or other
  misc_difference 436: note = a, t, c, g, unknown or other
  misc_difference 437: note = a, t, c, g, unknown or other
  misc_difference 438: note = a, t, c, g, unknown or other
  misc_difference 439: note = a, t, c, g, unknown or other
  misc_difference 440: note = a, t, c, g, unknown or other
  misc_difference 441: note = a, t, c, g, unknown or other
  misc_difference 442: note = a, t, c, g, unknown or other
  misc_difference 443: note = a, t, c, g, unknown or other
  misc_difference 444: note = a, t, c, g, unknown or other
  misc_difference 445: note = a, t, c, g, unknown or other
  misc_difference 446: note = a, t, c, g, unknown or other
  misc_difference 447: note = a, t, c, g, unknown or other
  misc_difference 448: note = a, t, c, g, unknown or other
  misc_difference 449: note = a, t, c, g, unknown or other
  misc_difference 450: note = a, t, c, g, unknown or other
  misc_difference 451: note = a, t, c, g, unknown or other
  misc_difference 452: note = a, t, c, g, unknown or other
  misc_difference 453: note = a, t, c, g, unknown or other
  misc_difference 454: note = a, t, c, g, unknown or other
  misc_difference 455: note = a, t, c, g, unknown or other
  misc_difference 456: note = a, t, c, g, unknown or other
  misc_difference 457: note = a, t, c, g, unknown or other
  misc_difference 458: note = a, t, c, g, unknown or other
  misc_difference 459: note = a, t, c, g, unknown or other
  misc_difference 460: note = a, t, c, g, unknown or other
  misc_difference 461: note = a, t, c, g, unknown or other
  misc_difference 462: note = a, t, c, g, unknown or other
  misc_difference 463: note = a, t, c, g, unknown or other
  misc_difference 464: note = a, t, c, g, unknown or other
  misc_difference 465: note = a, t, c, g, unknown or other
  misc_difference 466: note = a, t, c, g, unknown or other
  misc_difference 467: note = a, t, c, g, unknown or other
  misc_difference 468: note = a, t, c, g, unknown or other
  misc_difference 469: note = a, t, c, g, unknown or other
  misc_difference 470: note = a, t, c, g, unknown or other
  misc_difference 471: note = a, t, c, g, unknown or other
  misc_difference 472: note = a, t, c, g, unknown or other
  misc_difference 473: note = a, t, c, g, unknown or other
  misc_difference 474: note = a, t, c, g, unknown or other
  misc_difference 475: note = a, t, c, g, unknown or other
  misc_difference 476: note = a, t, c, g, unknown or other
  misc_difference 477: note = a, t, c, g, unknown or other
  misc_difference 478: note = a, t, c, g, unknown or other
  misc_difference 479: note = a, t, c, g, unknown or other
  misc_difference 480: note = a, t, c, g, unknown or other
  misc_difference 481: note = a, t, c, g, unknown or other
  misc_difference 482: note = a, t, c, g, unknown or other
  misc_difference 483: note = a, t, c, g, unknown or other
  misc_difference 484: note = a, t, c, g, unknown or other
  misc_difference 485: note = a, t, c, g, unknown or other
  misc_difference 486: note = a, t, c, g, unknown or other
  misc_difference 487: note = a, t, c, g, unknown or other
  misc_difference 488: note = a, t, c, g, unknown or other
  misc_difference 489: note = a, t, c, g, unknown or other
  misc_difference 490: note = a, t, c, g, unknown or other
  misc_difference 491: note = a, t, c, g, unknown or other
  misc_difference 492: note = a, t, c, g, unknown or other
  misc_difference 493: note = a, t, c, g, unknown or other
  misc_difference 494: note = a, t, c, g, unknown or other
  misc_difference 495: note = a, t, c, g, unknown or other
  misc_difference 496: note = a, t, c, g, unknown or other
  misc_difference 497: note = a, t, c, g, unknown or other
  misc_difference 498: note = a, t, c, g, unknown or other
  misc_difference 499: note = a, t, c, g, unknown or other
  misc_difference 500: note = a, t, c, g, unknown or other
  misc_difference 501: note = a, t, c, g, unknown or other
  misc_difference 502: note = a, t, c, g, unknown or other
  misc_difference 503: note = a, t, c, g, unknown or other
  misc_difference 504: note = a, t, c, g, unknown or other
  misc_difference 505: note = a, t, c, g, unknown or other
  misc_difference 506: note = a, t, c, g, unknown or other
  misc_difference 507: note = a, t, c, g, unknown or other
  misc_difference 508: note = a, t, c, g, unknown or other
  misc_difference 509: note = a, t, c, g, unknown or other
  misc_difference 510: note = a, t, c, g, unknown or other
  misc_difference 511: note = a, t, c, g, unknown or other
  misc_difference 512: note = a, t, c, g, unknown or other
  misc_difference 513: note = a, t, c, g, unknown or other
  misc_difference 514: note = a, t, c, g, unknown or other
  misc_difference 515: note = a, t, c, g, unknown or other
  misc_difference 516: note = a, t, c, g, unknown or other
  misc_difference 517: note = a, t, c, g, unknown or other
  misc_difference 518: note = a, t, c, g, unknown or other
  misc_difference 519: note = a, t, c, g, unknown or other
  misc_difference 520: note = a, t, c, g, unknown or other
  misc_difference 521: note = a, t, c, g, unknown or other
  misc_difference 522: note = a, t, c, g, unknown or other
  misc_difference 523: note = a, t, c, g, unknown or other
  misc_difference 524: note = a, t, c, g, unknown or other
  misc_difference 525: note = a, t, c, g, unknown or other
  misc_difference 526: note = a, t, c, g, unknown or other
  misc_difference 527: note = a, t, c, g, unknown or other
  misc_difference 528: note = a, t, c, g, unknown or other
  misc_difference 529: note = a, t, c, g, unknown or other
  misc_difference 530: note = a, t, c, g, unknown or other
  misc_difference 531: note = a, t, c, g, unknown or other
  misc_difference 532: note = a, t, c, g, unknown or other
  misc_difference 533: note = a, t, c, g, unknown or other
  misc_difference 534: note = a, t, c, g, unknown or other
  misc_difference 535: note = a, t, c, g, unknown or other
  misc_difference 536: note = a, t, c, g, unknown or other
  misc_difference 537: note = a, t, c, g, unknown or other
  misc_difference 538: note = a, t, c, g, unknown or other
  misc_difference 539: note = a, t, c, g, unknown or other
  misc_difference 540: note = a, t, c, g, unknown or other
  misc_difference 541: note = a, t, c, g, unknown or other
  misc_difference 542: note = a, t, c, g, unknown or other
  misc_difference 543: note = a, t, c, g, unknown or other
  misc_difference 544: note = a, t, c, g, unknown or other
  misc_difference 545: note = a, t, c, g, unknown or other
  misc_difference 546: note = a, t, c, g, unknown or other
  misc_difference 547: note = a, t, c, g, unknown or other
  misc_difference 548: note = a, t, c, g, unknown or other
  misc_difference 549: note = a, t, c, g, unknown or other
  misc_difference 550: note = a, t, c, g, unknown or other
  misc_difference 551: note = a, t, c, g, unknown or other
  misc_difference 552: note = a, t, c, g, unknown or other
  misc_difference 553: note = a, t, c, g, unknown or other
  misc_difference 554: note = a, t, c, g, unknown or other
  misc_difference 555: note = a, t, c, g, unknown or other
  misc_difference 556: note = a, t, c, g, unknown or other
  misc_difference 557: note = a, t, c, g, unknown or other
  misc_difference 558: note = a, t, c, g, unknown or other
  misc_difference 559: note = a, t, c, g, unknown or other
  misc_difference 560: note = a, t, c, g, unknown or other
  misc_difference 561: note = a, t, c, g, unknown or other
  misc_difference 562: note = a, t, c, g, unknown or other
  misc_difference 563: note = a, t, c, g, unknown or other
  misc_difference 564: note = a, t, c, g, unknown or other
  misc_difference 565: note = a, t, c, g, unknown or other
  misc_difference 566: note = a, t, c, g, unknown or other
  misc_difference 567: note = a, t, c, g, unknown or other
  misc_difference 568: note = a, t, c, g, unknown or other
  misc_difference 569: note = a, t, c, g, unknown or other
  misc_difference 570: note = a, t, c, g, unknown or other
  misc_difference 571: note = a, t, c, g, unknown or other
  misc_difference 572: note = a, t, c, g, unknown or other
  misc_difference 573: note = a, t, c, g, unknown or other
  misc_difference 574: note = a, t, c, g, unknown or other
  misc_difference 575: note = a, t, c, g, unknown or other
  misc_difference 576: note = a, t, c, g, unknown or other
  misc_difference 577: note = a, t, c, g, unknown or other
  misc_difference 578: note = a, t, c, g, unknown or other
  misc_difference 579: note = a, t, c, g, unknown or other
  misc_difference 580: note = a, t, c, g, unknown or other
  misc_difference 581: note = a, t, c, g, unknown or other
  misc_difference 582: note = a, t, c, g, unknown or other
  misc_difference 583: note = a, t, c, g, unknown or other
  misc_difference 584: note = a, t, c, g, unknown or other
  misc_difference 585: note = a, t, c, g, unknown or other
  misc_difference 586: note = a, t, c, g, unknown or other
  misc_difference 587: note = a, t, c, g, unknown or other
  misc_difference 588: note = a, t, c, g, unknown or other
  misc_difference 589: note = a, t, c, g, unknown or other
  misc_difference 590: note = a, t, c, g, unknown or other
  misc_difference 591: note = a, t, c, g, unknown or other
  misc_difference 592: note = a, t, c, g, unknown or other
  misc_difference 593: note = a, t, c, g, unknown or other
  misc_difference 594: note = a, t, c, g, unknown or other
  misc_difference 595: note = a, t, c, g, unknown or other
  misc_difference 596: note = a, t, c, g, unknown or other
  misc_difference 597: note = a, t, c, g, unknown or other
  misc_difference 598: note = a, t, c, g, unknown or other
  misc_difference 599: note = a, t, c, g, unknown or other
  misc_difference 600: note = a, t, c, g, unknown or other
  misc_difference 601: note = a, t, c, g, unknown or other
  misc_difference 602: note = a, t, c, g, unknown or other
  misc_difference 603: note = a, t, c, g, unknown or other
  misc_difference 604: note = a, t, c, g, unknown or other
  misc_difference 605: note = a, t, c, g, unknown or other
  misc_difference 606: note = a, t, c, g, unknown or other
  misc_difference 607: note = a, t, c, g, unknown or other
  misc_difference 608: note = a, t, c, g, unknown or other
  misc_difference 609: note = a, t, c, g, unknown or other
  misc_difference 610: note = a, t, c, g, unknown or other
  misc_difference 611: note = a, t, c, g, unknown or other
  misc_difference 612: note = a, t, c, g, unknown or other
  misc_difference 613: note = a, t, c, g, unknown or other
  misc_difference 614: note = a, t, c, g, unknown or other
  misc_difference 615: note = a, t, c, g, unknown or other
  misc_difference 616: note = a, t, c, g, unknown or other
  misc_difference 617: note = a, t, c, g, unknown or other
  misc_difference 618: note = a, t, c, g, unknown or other
  misc_difference 619: note = a, t, c, g, unknown or other
  misc_difference 620: note = a, t, c, g, unknown or other
  misc_difference 621: note = a, t, c, g, unknown or other
  misc_difference 622: note = a, t, c, g, unknown or other
  misc_difference 623: note = a, t, c, g, unknown or other
  misc_difference 624: note = a, t, c, g, unknown or other
  misc_difference 625: note = a, t, c, g, unknown or other
  misc_difference 626: note = a, t, c, g, unknown or other
  misc_difference 627: note = a, t, c, g, unknown or other
  misc_difference 628: note = a, t, c, g, unknown or other
  misc_difference 629: note = a, t, c, g, unknown or other
  misc_difference 630: note = a, t, c, g, unknown or other
  misc_difference 631: note = a, t, c, g, unknown or other
  misc_difference 632: note = a, t, c, g, unknown or other
  misc_difference 633: note = a, t, c, g, unknown or other
  misc_difference 634: note = a, t, c, g, unknown or other
  misc_difference 635: note = a, t, c, g, unknown or other
  misc_difference 636: note = a, t, c, g, unknown or other
  misc_difference 637: note = a, t, c, g, unknown or other
  misc_difference 638: note = a, t, c, g, unknown or other
  misc_difference 639: note = a, t, c, g, unknown or other
  misc_difference 640: note = a, t, c, g, unknown or other
  misc_difference 641: note = a, t, c, g, unknown or other
  misc_difference 642: note = a, t, c, g, unknown or other
  misc_difference 643: note = a, t, c, g, unknown or other
  misc_difference 644: note = a, t, c, g, unknown or other
  misc_difference 645: note = a, t, c, g, unknown or other
  misc_difference 646: note = a, t, c, g, unknown or other
  misc_difference 647: note = a, t, c, g, unknown or other
  misc_difference 648: note = a, t, c, g, unknown or other
  misc_difference 649: note = a, t, c, g, unknown or other
  misc_difference 650: note = a, t, c, g, unknown or other
  misc_difference 651: note = a, t, c, g, unknown or other
  misc_difference 652: note = a, t, c, g, unknown or other
  misc_difference 653: note = a, t, c, g, unknown or other
  misc_difference 654: note = a, t, c, g, unknown or other
  misc_difference 655: note = a, t, c, g, unknown or other
  misc_difference 656: note = a, t, c, g, unknown or other
  misc_difference 657: note = a, t, c, g, unknown or other
  misc_difference 658: note = a, t, c, g, unknown or other
  misc_difference 659: note = a, t, c, g, unknown or other
  misc_difference 660: note = a, t, c, g, unknown or other
  misc_difference 661: note = a, t, c, g, unknown or other
  misc_difference 662: note = a, t, c, g, unknown or other
  misc_difference 663: note = a, t, c, g, unknown or other
  misc_difference 664: note = a, t, c, g, unknown or other
  misc_difference 665: note = a, t, c, g, unknown or other
  misc_difference 666: note = a, t, c, g, unknown or other
  misc_difference 667: note = a, t, c, g, unknown or other
  misc_difference 668: note = a, t, c, g, unknown or other
  misc_difference 669: note = a, t, c, g, unknown or other
  misc_difference 670: note = a, t, c, g, unknown or other
  misc_difference 671: note = a, t, c, g, unknown or other
  misc_difference 672: note = a, t, c, g, unknown or other
  misc_difference 673: note = a, t, c, g, unknown or other
  misc_difference 674: note = a, t, c, g, unknown or other
  misc_difference 675: note = a, t, c, g, unknown or other
  misc_difference 676: note = a, t, c, g, unknown or other
  misc_difference 677: note = a, t, c, g, unknown or other
  misc_difference 678: note = a, t, c, g, unknown or other
  misc_difference 679: note = a, t, c, g, unknown or other
  misc_difference 680: note = a, t, c, g, unknown or other
  misc_difference 681: note = a, t, c, g, unknown or other
  misc_difference 682: note = a, t, c, g, unknown or other
  misc_difference 683: note = a, t, c, g, unknown or other
  misc_difference 684: note = a, t, c, g, unknown or other
  misc_difference 685: note = a, t, c, g, unknown or other
  misc_difference 686: note = a, t, c, g, unknown or other
  misc_difference 687: note = a, t, c, g, unknown or other
  misc_difference 688: note = a, t, c, g, unknown or other
  misc_difference 689: note = a, t, c, g, unknown or other
  misc_difference 690: note = a, t, c, g, unknown or other
  misc_difference 691: note = a, t, c, g, unknown or other
  misc_difference 692: note = a, t, c, g, unknown or other
  misc_difference 693: note = a, t, c, g, unknown or other
  misc_difference 694: note = a, t, c, g, unknown or other
  misc_difference 695: note = a, t, c, g, unknown or other
  misc_difference 696: note = a, t, c, g, unknown or other
  misc_difference 697: note = a, t, c, g, unknown or other
  misc_difference 698: note = a, t, c, g, unknown or other
  misc_difference 699: note = a, t, c, g, unknown or other
  misc_difference 700: note = a, t, c, g, unknown or other
  misc_difference 701: note = a, t, c, g, unknown or other
  misc_difference 702: note = a, t, c, g, unknown or other
  misc_difference 703: note = a, t, c, g, unknown or other
  misc_difference 704: note = a, t, c, g, unknown or other
  misc_difference 705: note = a, t, c, g, unknown or other
  misc_difference 706: note = a, t, c, g, unknown or other
  misc_difference 707: note = a, t, c, g, unknown or other
  misc_difference 708: note = a, t, c, g, unknown or other
  misc_difference 709: note = a, t, c, g, unknown or other
  misc_difference 710: note = a, t, c, g, unknown or other
  misc_difference 711: note = a, t, c, g, unknown or other
  misc_difference 712: note = a, t, c, g, unknown or other
  misc_difference 713: note = a, t, c, g, unknown or other
  misc_difference 714: note = a, t, c, g, unknown or other
  misc_difference 715: note = a, t, c, g, unknown or other
  misc_difference 716: note = a, t, c, g, unknown or other
  misc_difference 717: note = a, t, c, g, unknown or other
  misc_difference 718: note = a, t, c, g, unknown or other
  misc_difference 719: note = a, t, c, g, unknown or other
  misc_difference 720: note = a, t, c, g, unknown or other
  misc_difference 721: note = a, t, c, g, unknown or other
  misc_difference 722: note = a, t, c, g, unknown or other
  misc_difference 723: note = a, t, c, g, unknown or other
  misc_difference 724: note = a, t, c, g, unknown or other
  misc_difference 725: note = a, t, c, g, unknown or other
  misc_difference 726: note = a, t, c, g, unknown or other
  misc_difference 727: note = a, t, c, g, unknown or other
  misc_difference 728: note = a, t, c, g, unknown or other
  misc_difference 729: note = a, t, c, g, unknown or other
  misc_difference 730: note = a, t, c, g, unknown or other
  misc_difference 731: note = a, t, c, g, unknown or other
  misc_difference 732: note = a, t, c, g, unknown or other
  misc_difference 733: note = a, t, c, g, unknown or other
  misc_difference 734: note = a, t, c, g, unknown or other
  misc_difference 735: note = a, t, c, g, unknown or other
  misc_difference 736: note = a, t, c, g, unknown or other
  misc_difference 737: note = a, t, c, g, unknown or other
  misc_difference 738: note = a, t, c, g, unknown or other
  misc_difference 739: note = a, t, c, g, unknown or other
  misc_difference 740: note = a, t, c, g, unknown or other
  misc_difference 741: note = a, t, c, g, unknown or other
  misc_difference 742: note = a, t, c, g, unknown or other
  misc_difference 743: note = a, t, c, g, unknown or other
  misc_difference 744: note = a, t, c, g, unknown or other
  misc_difference 745: note = a, t, c, g, unknown or other
  misc_difference 746: note = a, t, c, g, unknown or other
  misc_difference 747: note = a, t, c, g, unknown or other
  misc_difference 748: note = a, t, c, g, unknown or other
  misc_difference 749: note = a, t, c, g, unknown or other
  misc_difference 750: note = a, t, c, g, unknown or other
  misc_difference 751: note = a, t, c, g, unknown or other
  misc_difference 752: note = a, t, c, g, unknown or other
  misc_difference 753: note = a, t, c, g, unknown or other
  misc_difference 754: note = a, t, c, g, unknown or other
  misc_difference 755: note = a, t, c, g, unknown or other
  misc_difference 756: note = a, t, c, g, unknown or other
  misc_difference 757: note = a, t, c, g, unknown or other
  misc_difference 758: note = a, t, c, g, unknown or other
  misc_difference 759: note = a, t, c, g, unknown or other
  misc_difference 760: note = a, t, c, g, unknown or other
  misc_difference 761: note = a, t, c, g, unknown or other
  misc_difference 762: note = a, t, c, g, unknown or other
  misc_difference 763: note = a, t, c, g, unknown or other
  misc_difference 764: note = a, t, c, g, unknown or other
  misc_difference 765: note = a, t, c, g, unknown or other
  misc_difference 766: note = a, t, c, g, unknown or other
  misc_difference 767: note = a, t, c, g, unknown or other
  misc_difference 768: note = a, t, c, g, unknown or other
  misc_difference 769: note = a, t, c, g, unknown or other
  misc_difference 770: note = a, t, c, g, unknown or other
  misc_difference 771: note = a, t, c, g, unknown or other
  misc_difference 772: note = a, t, c, g, unknown or other
  misc_difference 773: note = a, t, c, g, unknown or other
  misc_difference 774: note = a, t, c, g, unknown or other
  misc_difference 775: note = a, t, c, g, unknown or other
  misc_difference 776: note = a, t, c, g, unknown or other
  misc_difference 777: note = a, t, c, g, unknown or other
  misc_difference 778: note = a, t, c, g, unknown or other
  misc_difference 779: note = a, t, c, g, unknown or other
  misc_difference 780: note = a, t, c, g, unknown or other
  misc_difference 781: note = a, t, c, g, unknown or other
  misc_difference 782: note = a, t, c, g, unknown or other
  misc_difference 783: note = a, t, c, g, unknown or other
  misc_difference 784: note = a, t, c, g, unknown or other
  misc_difference 785: note = a, t, c, g, unknown or other
  misc_difference 786: note = a, t, c, g, unknown or other
  misc_difference 787: note = a, t, c, g, unknown or other
  misc_difference 788: note = a, t, c, g, unknown or other
  misc_difference 789: note = a, t, c, g, unknown or other
  misc_difference 790: note = a, t, c, g, unknown or other
  misc_difference 791: note = a, t, c, g, unknown or other
  misc_difference 792: note = a, t, c, g, unknown or other
  misc_difference 793: note = a, t, c, g, unknown or other
  misc_difference 794: note = a, t, c, g, unknown or other
  misc_difference 795: note = a, t, c, g, unknown or other
  misc_difference 796: note = a, t, c, g, unknown or other
  misc_difference 797: note = a, t, c, g, unknown or other
  misc_difference 798: note = a, t, c, g, unknown or other
  misc_difference 799: note = a, t, c, g, unknown or other
  misc_difference 800: note = a, t, c, g, unknown or other
  misc_difference 801: note = a, t, c, g, unknown or other
  misc_difference 802: note = a, t, c, g, unknown or other
  misc_difference 803: note = a, t, c, g, unknown or other
  misc_difference 804: note = a, t, c, g, unknown or other
  misc_difference 805: note = a, t, c, g, unknown or other
  misc_difference 806: note = a, t, c, g, unknown or other
  misc_difference 807: note = a, t, c, g, unknown or other
  misc_difference 808: note = a, t, c, g, unknown or other
  misc_difference 809: note = a, t, c, g, unknown or other
  misc_difference 810: note = a, t, c, g, unknown or other
  misc_difference 811: note = a, t, c, g, unknown or other
  misc_difference 812: note = a, t, c, g, unknown or other
  misc_difference 813: note = a, t, c, g, unknown or other
  misc_difference 814: note = a, t, c, g, unknown or other
  misc_difference 815: note = a, t, c, g, unknown or other
  misc_difference 816: note = a, t, c, g, unknown or other
  misc_difference 817: note = a, t, c, g, unknown or other
  misc_difference 818: note = a, t, c, g, unknown or other
  misc_difference 819: note = a, t, c, g, unknown or other
  misc_difference 820: note = a, t, c, g, unknown or other
  misc_difference 821: note = a, t, c, g, unknown or other
  misc_difference 822: note = a, t, c, g, unknown or other
  misc_difference 823: note = a, t, c, g, unknown or other
  misc_difference 824: note = a, t, c, g, unknown or other
  misc_difference 825: note = a, t, c, g, unknown or other
  misc_difference 826: note = a, t, c, g, unknown or other
  misc_difference 827: note = a, t, c, g, unknown or other
  misc_difference 828: note = a, t, c, g, unknown or other
  misc_difference 829: note = a, t, c, g, unknown or other
  misc_difference 830: note = a, t, c, g, unknown or other
  misc_difference 831: note = a, t, c, g, unknown or other
  misc_difference 832: note = a, t, c, g, unknown or other
  misc_difference 833: note = a, t, c, g, unknown or other
  misc_difference 834: note = a, t, c, g, unknown or other
  misc_difference 835: note = a, t, c, g, unknown or other
  misc_difference 836: note = a, t, c, g, unknown or other
  misc_difference 837: note = a, t, c, g, unknown or other
  misc_difference 838: note = a, t, c, g, unknown or other
  misc_difference 839: note = a, t, c, g, unknown or other
  misc_difference 840: note = a, t, c, g, unknown or other
  misc_difference 841: note = a, t, c, g, unknown or other
  misc_difference 842: note = a, t, c, g, unknown or other
  misc_difference 843: note = a, t, c, g, unknown or other
  misc_difference 844: note = a, t, c, g, unknown or other
  misc_difference 845: note = a, t, c, g, unknown or other
  misc_difference 846: note = a, t, c, g, unknown or other
  misc_difference 847: note = a, t, c, g, unknown or other
  misc_difference 848: note = a, t, c, g, unknown or other
  misc_difference 849: note = a, t, c, g, unknown or other
  misc_difference 850: note = a, t, c, g, unknown or other
  misc_difference 851: note = a, t, c, g, unknown or other
  misc_difference 852: note = a, t, c, g, unknown or other
  misc_difference 853: note = a, t, c, g, unknown or other
  misc_difference 854: note = a, t, c, g, unknown or other
  misc_difference 855: note = a, t, c, g, unknown or other
  misc_difference 856: note = a, t, c, g, unknown or other
  misc_difference 857: note = a, t, c, g, unknown or other
  misc_difference 858: note = a, t, c, g, unknown or other
  misc_difference 859: note = a, t, c, g, unknown or other
  misc_difference 860: note = a, t, c, g, unknown or other
  misc_difference 861: note = a, t, c, g, unknown or other
  misc_difference 862: note = a, t, c, g, unknown or other
  misc_difference 863: note = a, t, c, g, unknown or other
  misc_difference 864: note = a, t, c, g, unknown or other
  misc_difference 865: note = a, t, c, g, unknown or other
  misc_difference 866: note = a, t, c, g, unknown or other
  misc_difference 867: note = a, t, c, g, unknown or other
  misc_difference 868: note = a, t, c, g, unknown or other
  misc_difference 869: note = a, t, c, g, unknown or other
  misc_difference 870: note = a, t, c, g, unknown or other
  misc_difference 871: note = a, t, c, g, unknown or other
  misc_difference 872: note = a, t, c, g, unknown or other
  misc_difference 873: note = a, t, c, g, unknown or other
  misc_difference 874: note = a, t, c, g, unknown or other
  misc_difference 875: note = a, t, c, g, unknown or other
  misc_difference 876: note = a, t, c, g, unknown or other
  misc_difference 877: note = a, t, c, g, unknown or other
  misc_difference 878: note = a, t, c, g, unknown or other
  misc_difference 879: note = a, t, c, g, unknown or other
  misc_difference 880: note = a, t, c, g, unknown or other
  misc_difference 881: note = a, t, c, g, unknown or other
  misc_difference 882: note = a, t, c, g, unknown or other
  misc_difference 883: note = a, t, c, g, unknown or other
  misc_difference 884: note = a, t, c, g, unknown or other
  misc_difference 885: note = a, t, c, g, unknown or other
  misc_difference 886: note = a, t, c, g, unknown or other
  misc_difference 887: note = a, t, c, g, unknown or other
  misc_difference 888: note = a, t, c, g, unknown or other
  misc_difference 889: note = a, t, c, g, unknown or other
  misc_difference 890: note = a, t, c, g, unknown or other
  misc_difference 891: note = a, t, c, g, unknown or other
  misc_difference 892: note = a, t, c, g, unknown or other
  misc_difference 893: note = a, t, c, g, unknown or other
  misc_difference 894: note = a, t, c, g, unknown or other
  misc_difference 895: note = a, t, c, g, unknown or other
  misc_difference 896: note = a, t, c, g, unknown or other
  misc_difference 897: note = a, t, c, g, unknown or other
  misc_difference 898: note = a, t, c, g, unknown or other
  misc_difference 899: note = a, t, c, g, unknown or other
  misc_difference 900: note = a, t, c, g, unknown or other
  misc_difference 901: note = a, t, c, g, unknown or other
  misc_difference 902: note = a, t, c, g, unknown or other
  misc_difference 903: note = a, t, c, g, unknown or other
  misc_difference 904: note = a, t, c, g, unknown or other
  misc_difference 905: note = a, t, c, g, unknown or other
  misc_difference 906: note = a, t, c, g, unknown or other
  misc_difference 907: note = a, t, c, g, unknown or other
  misc_difference 908: note = a, t, c, g, unknown or other
  misc_difference 909: note = a, t, c, g, unknown or other
  misc_difference 910: note = a, t, c, g, unknown or other
  misc_difference 911: note = a, t, c, g, unknown or other
  misc_difference 912: note = a, t, c, g, unknown or other
  misc_difference 913: note = a, t, c, g, unknown or other
  misc_difference 914: note = a, t, c, g, unknown or other
  misc_difference 915: note = a, t, c, g, unknown or other
  misc_difference 916: note = a, t, c, g, unknown or other
  misc_difference 917: note = a, t, c, g, unknown or other
  misc_difference 918: note = a, t, c, g, unknown or other
  misc_difference 919: note = a, t, c, g, unknown or other
  misc_difference 920: note = a, t, c, g, unknown or other
  misc_difference 921: note = a, t, c, g, unknown or other
  misc_difference 922: note = a, t, c, g, unknown or other
  misc_difference 923: note = a, t, c, g, unknown or other
  misc_difference 924: note = a, t, c, g, unknown or other
  misc_difference 925: note = a, t, c, g, unknown or other
  misc_difference 926: note = a, t, c, g, unknown or other
  misc_difference 927: note = a, t, c, g, unknown or other
  misc_difference 928: note = a, t, c, g, unknown or other
  misc_difference 929: note = a, t, c, g, unknown or other
  misc_difference 930: note = a, t, c, g, unknown or other
  misc_difference 931: note = a, t, c, g, unknown or other
  misc_difference 932: note = a, t, c, g, unknown or other
  misc_difference 933: note = a, t, c, g, unknown or other
  misc_difference 934: note = a, t, c, g, unknown or other
  misc_difference 935: note = a, t, c, g, unknown or other
  misc_difference 936: note = a, t, c, g, unknown or other
  misc_difference 937: note = a, t, c, g, unknown or other
  misc_difference 938: note = a, t, c, g, unknown or other
  misc_difference 939: note = a, t, c, g, unknown or other
  misc_difference 940: note = a, t, c, g, unknown or other
  misc_difference 941: note = a, t, c, g, unknown or other
  misc_difference 942: note = a, t, c, g, unknown or other
  misc_difference 943: note = a, t, c, g, unknown or other
  misc_difference 944: note = a, t, c, g, unknown or other
  misc_difference 945: note = a, t, c, g, unknown or other
  misc_difference 946: note = a, t, c, g, unknown or other
  misc_difference 947: note = a, t, c, g, unknown or other
  misc_difference 948: note = a, t, c, g, unknown or other
  misc_difference 949: note = a, t, c, g, unknown or other
  misc_difference 950: note = a, t, c, g, unknown or other
  misc_difference 951: note = a, t, c, g, unknown or other
  misc_difference 952: note = a, t, c, g, unknown or other
  misc_difference 953: note = a, t, c, g, unknown or other
  misc_difference 954: note = a, t, c, g, unknown or other
  misc_difference 955: note = a, t, c, g, unknown or other
  misc_difference 956: note = a, t, c, g, unknown or other
  misc_difference 957: note = a, t, c, g, unknown or other
  misc_difference 958: note = a, t, c, g, unknown or other
  misc_difference 959: note = a, t, c, g, unknown or other
  misc_difference 960: note = a, t, c, g, unknown or other
  misc_difference 961: note = a, t, c, g, unknown or other
  misc_difference 962: note = a, t, c, g, unknown or other
  misc_difference 963: note = a, t, c, g, unknown or other
  misc_difference 964: note = a, t, c, g, unknown or other
  misc_difference 965: note = a, t, c, g, unknown or other
  misc_difference 966: note = a, t, c, g, unknown or other
  misc_difference 967: note = a, t, c, g, unknown or other
  misc_difference 968: note = a, t, c, g, unknown or other
  misc_difference 969: note = a, t, c, g, unknown or other
  misc_difference 970: note = a, t, c, g, unknown or other
  misc_difference 971: note = a, t, c, g, unknown or other
  misc_difference 972: note = a, t, c, g, unknown or other
  misc_difference 973: note = a, t, c, g, unknown or other
  misc_difference 974: note = a, t, c, g, unknown or other
  misc_difference 975: note = a, t, c, g, unknown or other
  misc_difference 976: note = a, t, c, g, unknown or other
  misc_difference 977: note = a, t, c, g, unknown or other
  misc_difference 978: note = a, t, c, g, unknown or other
  misc_difference 979: note = a, t, c, g, unknown or other
  misc_difference 980: note = a, t, c, g, unknown or other
  misc_difference 981: note = a, t, c, g, unknown or other
  misc_difference 982: note = a, t, c, g, unknown or other
  misc_difference 983: note = a, t, c, g, unknown or other
  misc_difference 984: note = a, t, c, g, unknown or other
  misc_difference 985: note = a, t, c, g, unknown or other
  misc_difference 986: note = a, t, c, g, unknown or other
  misc_difference 987: note = a, t, c, g, unknown or other
  misc_difference 988: note = a, t, c, g, unknown or other
  misc_difference 989: note = a, t, c, g, unknown or other
  misc_difference 990: note = a, t, c, g, unknown or other
  misc_difference 991: note = a, t, c, g, unknown or other
  misc_difference 992: note = a, t, c, g, unknown or other
  misc_difference 993: note = a, t, c, g, unknown or other
  misc_difference 994: note = a, t, c, g, unknown or other
  misc_difference 995: note = a, t, c, g, unknown or other
  misc_difference 996: note = a, t, c, g, unknown or other
  misc_difference 997: note = a, t, c, g, unknown or other
  misc_difference 998: note = a, t, c, g, unknown or other
  misc_difference 999: note = a, t, c, g, unknown or other
  misc_difference 1000: note = a, t, c, g, unknown or other
  misc_difference 1001..1019: note = a, t, c, g, unknown or other
  modified_base 1038: mod_base = OTHER; note = hydroxy cytidine
acagtcagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtcaaggtcgccagccc

SEQ ID NO: 4 - DNA, 1039 bp, synthetic construct
  source 1..1039: mol_type = other DNA
  modified_base 1: mod_base = OTHER; note = Phosphate thymidine
  misc_difference 7: note = a, t, c, g, unknown or other
  misc_difference 8: note = a, t, c, g, unknown or other
  misc_difference 9: note = a, t, c, g, unknown or other
  misc_difference 10: note = a, t, c, g, unknown or other
  misc_difference 11: note = a, t, c, g, unknown or other
  misc_difference 12: note = a, t, c, g, unknown or other
  misc_difference 13: note = a, t, c, g, unknown or other
  misc_difference 14: note = a, t, c, g, unknown or other
  misc_difference 15: note = a, t, c, g, unknown or other
  misc_difference 16: note = a, t, c, g, unknown or other
  misc_difference 17: note = a, t, c, g, unknown or other
  misc_difference 18: note = a, t, c, g, unknown or other
  misc_difference 19: note = a, t, c, g, unknown or other
  misc_difference 20: note = a, t, c, g, unknown or other
  misc_difference 21: note = a, t, c, g, unknown or other
  misc_difference 22: note = a, t, c, g, unknown or other
  misc_difference 23: note = a, t, c, g, unknown or other
  misc_difference 24: note = a, t, c, g, unknown or other
  misc_difference 25: note = a, t, c, g, unknown or other
  misc_difference 26: note = a, t, c, g, unknown or other
  misc_difference 27: note = a, t, c, g, unknown or other
  misc_difference 28: note = a, t, c, g, unknown or other
  misc_difference 29: note = a, t, c, g, unknown or other
  misc_difference 30: note = a, t, c, g, unknown or other
  misc_difference 31: note = a, t, c, g, unknown or other
  misc_difference 32: note = a, t, c, g, unknown or other
  misc_difference 33: note = a, t, c, g, unknown or other
  misc_difference 34: note = a, t, c, g, unknown or other
  misc_difference 35: note = a, t, c, g, unknown or other
  misc_difference 36: note = a, t, c, g, unknown or other
  misc_difference 37: note = a, t, c, g, unknown or other
  misc_difference 38: note = a, t, c, g, unknown or other
  misc_difference 39: note = a, t, c, g, unknown or other
  misc_difference 40: note = a, t, c, g, unknown or other
  misc_difference 41: note = a, t, c, g, unknown or other
  misc_difference 42: note = a, t, c, g, unknown or other
  misc_difference 43: note = a, t, c, g, unknown or other
  misc_difference 44: note = a, t, c, g, unknown or other
  misc_difference 45: note = a, t, c, g, unknown or other
  misc_difference 46: note = a, t, c, g, unknown or other
  misc_difference 47: note = a, t, c, g, unknown or other
  misc_difference 48: note = a, t, c, g, unknown or other
  misc_difference 49: note = a, t, c, g, unknown or other
  misc_difference 50: note = a, t, c, g, unknown or other
  misc_difference 51: note = a, t, c, g, unknown or other
  misc_difference 52: note = a, t, c, g, unknown or other
  misc_difference 53: note = a, t, c, g, unknown or other
  misc_difference 54: note = a, t, c, g, unknown or other
  misc_difference 55: note = a, t, c, g, unknown or other
  misc_difference 56: note = a, t, c, g, unknown or other
  misc_difference 57: note = a, t, c, g, unknown or other
  misc_difference 58: note = a, t, c, g, unknown or other
  misc_difference 59: note = a, t, c, g, unknown or other
  misc_difference 60: note = a, t, c, g, unknown or other
  misc_difference 61: note = a, t, c, g, unknown or other
  misc_difference 62: note = a, t, c, g, unknown or other
  misc_difference 63: note = a, t, c, g, unknown or other
  misc_difference 64: note = a, t, c, g, unknown or other
  misc_difference 65: note = a, t, c, g, unknown or other
  misc_difference 66: note = a, t, c, g, unknown or other
  misc_difference 67: note = a, t, c, g, unknown or other
  misc_difference 68: note = a, t, c, g, unknown or other
  misc_difference 69: note = a, t, c, g, unknown or other
  misc_difference 70: note = a, t, c, g, unknown or other
  misc_difference 71: note = a, t, c, g, unknown or other
  misc_difference 72: note = a, t, c, g, unknown or other
  misc_difference 73: note = a, t, c, g, unknown or other
  misc_difference 74: note = a, t, c, g, unknown or other
  misc_difference 75: note = a, t, c, g, unknown or other
  misc_difference 76: note = a, t, c, g, unknown or other
  misc_difference 77: note = a, t, c, g, unknown or other
  misc_difference 78: note = a, t, c, g, unknown or other
  misc_difference 79: note = a, t, c, g, unknown or other
  misc_difference 80: note = a, t, c, g, unknown or other
  misc_difference 81: note = a, t, c, g, unknown or other
  misc_difference 82: note = a, t, c, g, unknown or other
  misc_difference 83: note = a, t, c, g, unknown or other
  misc_difference 84: note = a, t, c, g, unknown or other
  misc_difference 85: note = a, t, c, g, unknown or other
  misc_difference 86: note = a, t, c, g, unknown or other
  misc_difference 87: note = a, t, c, g, unknown or other
  misc_difference 88: note = a, t, c, g, unknown or other
  misc_difference 89: note = a, t, c, g, unknown or other
  misc_difference 90: note = a, t, c, g, unknown or other
  misc_difference 91: note = a, t, c, g, unknown or other
  misc_difference 92: note = a, t, c, g, unknown or other
  misc_difference 93: note = a, t, c, g, unknown or other
  misc_difference 94: note = a, t, c, g, unknown or other
  misc_difference 95: note = a, t, c, g, unknown or other
  misc_difference 96: note = a, t, c, g, unknown or other
  misc_difference 97: note = a, t, c, g, unknown or other
  misc_difference 98: note = a, t, c, g, unknown or other
  misc_difference 99: note = a, t, c, g, unknown or other
  misc_difference 100: note = a, t, c, g, unknown or other
  misc_difference 101: note = a, t, c, g, unknown or other
  misc_difference 102: note = a, t, c, g, unknown or other
  misc_difference 103: note = a, t, c, g, unknown or other
  misc_difference 104: note = a, t, c, g, unknown or other
  misc_difference 105: note = a, t, c, g, unknown or other
  misc_difference 106: note = a, t, c, g, unknown or other
  misc_difference 107: note = a, t, c, g, unknown or other
  misc_difference 108: note = a, t, c, g, unknown or other
  misc_difference 109: note = a, t, c, g, unknown or other
  misc_difference 110: note = a, t, c, g, unknown or other
  misc_difference 111: note = a, t, c, g, unknown or other
  misc_difference 112: note = a, t, c, g, unknown or other
  misc_difference 113: note = a, t, c, g, unknown or other
  misc_difference 114: note = a, t, c, g, unknown or other
  misc_difference 115: note = a, t, c, g, unknown or other
  misc_difference 116: note = a, t, c, g, unknown or other
  misc_difference 117: note = a, t, c, g, unknown or other
  misc_difference 118: note = a, t, c, g, unknown or other
  misc_difference 119: note = a, t, c, g, unknown or other
  misc_difference 120: note = a, t, c, g, unknown or other
  misc_difference 121: note = a, t, c, g, unknown or other
  misc_difference 122: note = a, t, c, g, unknown or other
  misc_difference 123: note = a, t, c, g, unknown or other
  misc_difference 124: note = a, t, c, g, unknown or other
  misc_difference 125: note = a, t, c, g, unknown or other
  misc_difference 126: note = a, t, c, g, unknown or other
  misc_difference 127: note = a, t, c, g, unknown or other
  misc_difference 128: note = a, t, c, g, unknown or other
  misc_difference 129: note = a, t, c, g, unknown or other
  misc_difference 130: note = a, t, c, g, unknown or other
  misc_difference 131: note = a, t, c, g, unknown or other
  misc_difference 132: note = a, t, c, g, unknown or other
  misc_difference 133: note = a, t, c, g, unknown or other
  misc_difference 134: note = a, t, c, g, unknown or other
  misc_difference 135: note = a, t, c, g, unknown or other
  misc_difference 136: note = a, t, c, g, unknown or other
  misc_difference 137: note = a, t, c, g, unknown or other
  misc_difference 138: note = a, t, c, g, unknown or other
  misc_difference 139: note = a, t, c, g, unknown or other
  misc_difference 140: note = a, t, c, g, unknown or other
  misc_difference 141: note = a, t, c, g, unknown or other
  misc_difference 142: note = a, t, c, g, unknown or other
  misc_difference 143: note = a, t, c, g, unknown or other
  misc_difference 144: note = a, t, c, g, unknown or other
  misc_difference 145: note = a, t, c, g, unknown or other
  misc_difference 146: note = a, t, c, g, unknown or other
  misc_difference 147: note = a, t, c, g, unknown or other
  misc_difference 148: note = a, t, c, g, unknown or other
  misc_difference 149: note = a, t, c, g, unknown or other
  misc_difference 150: note = a, t, c, g, unknown or other
  misc_difference 151: note = a, t, c, g, unknown or other
  misc_difference 152: note = a, t, c, g, unknown or other
  misc_difference 153: note = a, t, c, g, unknown or other
  misc_difference 154: note = a, t, c, g, unknown or other
  misc_difference 155: note = a, t, c, g, unknown or other
  misc_difference 156: note = a, t, c, g, unknown or other
  misc_difference 157: note = a, t, c, g, unknown or other
  misc_difference 158: note = a, t, c, g, unknown or other
  misc_difference 159: note = a, t, c, g, unknown or other
  misc_difference 160: note = a, t, c, g, unknown or other
  misc_difference 161: note = a, t, c, g, unknown or other
  misc_difference 162: note = a, t, c, g, unknown or other
  misc_difference 163: note = a, t, c, g, unknown or other
  misc_difference 164: note = a, t, c, g, unknown or other
  misc_difference 165: note = a, t, c, g, unknown or other
  misc_difference 166: note = a, t, c, g, unknown or other
  misc_difference 167: note = a, t, c, g, unknown or other
  misc_difference 168: note = a, t, c, g, unknown or other
  misc_difference 169: note = a, t, c, g, unknown or other
  misc_difference 170: note = a, t, c, g, unknown or other
  misc_difference 171: note = a, t, c, g, unknown or other
  misc_difference 172: note = a, t, c, g, unknown or other
  misc_difference 173: note = a, t, c, g, unknown or other
  misc_difference 174: note = a, t, c, g, unknown or other
  misc_difference 175: note = a, t, c, g, unknown or other
  misc_difference 176: note = a, t, c, g, unknown or other
  misc_difference 177: note = a, t, c, g, unknown or other
  misc_difference 178: note = a, t, c, g, unknown or other
  misc_difference 179: note = a, t, c, g, unknown or other
  misc_difference 180: note = a, t, c, g, unknown or other
  misc_difference 181: note = a, t, c, g, unknown or other
  misc_difference 182: note = a, t, c, g, unknown or other
  misc_difference 183: note = a, t, c, g, unknown or other
  misc_difference 184: note = a, t, c, g, unknown or other
  misc_difference 185: note = a, t, c, g, unknown or other
  misc_difference 186: note = a, t, c, g, unknown or other
  misc_difference 187: note = a, t, c, g, unknown or other
  misc_difference 188: note = a, t, c, g, unknown or other
  misc_difference 189: note = a, t, c, g, unknown or other
  misc_difference 190: note = a, t, c, g, unknown or other
  misc_difference 191: note = a, t, c, g, unknown or other
  misc_difference 192: note = a, t, c, g, unknown or other
  misc_difference 193: note = a, t, c, g, unknown or other
  misc_difference 194: note = a, t, c, g, unknown or other
  misc_difference 195: note = a, t, c, g, unknown or other
  misc_difference 196: note = a, t, c, g, unknown or other
  misc_difference 197: note = a, t, c, g, unknown or other
  misc_difference 198: note = a, t, c, g, unknown or other
  misc_difference 199: note = a, t, c, g, unknown or other
  misc_difference 200: note = a, t, c, g, unknown or other
  misc_difference 201: note = a, t, c, g, unknown or other
  misc_difference 202: note = a, t, c, g, unknown or other
  misc_difference 203: note = a, t, c, g, unknown or other
  misc_difference 204: note = a, t, c, g, unknown or other
  misc_difference 205: note = a, t, c, g, unknown or other
  misc_difference 206: note = a, t, c, g, unknown or other
  misc_difference 207: note = a, t, c, g, unknown or other
  misc_difference 208: note = a, t, c, g, unknown or other
  misc_difference 209: note = a, t, c, g, unknown or other
  misc_difference 210: note = a, t, c, g, unknown or other
  misc_difference 211: note = a, t, c, g, unknown or other
  misc_difference 212: note = a, t, c, g, unknown or other
  misc_difference 213: note = a, t, c, g, unknown or other
  misc_difference 214: note = a, t, c, g, unknown or other
  misc_difference 215: note = a, t, c, g, unknown or other
  misc_difference 216: note = a, t, c, g, unknown or other
  misc_difference 217: note = a, t, c, g, unknown or other
  misc_difference 218: note = a, t, c, g, unknown or other
  misc_difference 219: note = a, t, c, g, unknown or other
  misc_difference 220: note = a, t, c, g, unknown or other
  misc_difference 221: note = a, t, c, g, unknown or other
  misc_difference 222: note = a, t, c, g, unknown or other
  misc_difference 223: note = a, t, c, g, unknown or other
  misc_difference 224: note = a, t, c, g, unknown or other
  misc_difference 225: note = a, t, c, g, unknown or other
  misc_difference 226: note = a, t, c, g, unknown or other
  misc_difference 227: note = a, t, c, g, unknown or other
  misc_difference 228: note = a, t, c, g, unknown or other
  misc_difference 229: note = a, t, c, g, unknown or other
  misc_difference 230: note = a, t, c, g, unknown or other
  misc_difference 231: note = a, t, c, g, unknown or other
  misc_difference 232: note = a, t, c, g, unknown or other
  misc_difference 233: note = a, t, c, g, unknown or other
  misc_difference 234: note = a, t, c, g, unknown or other
  misc_difference 235: note = a, t, c, g, unknown or other
  misc_difference 236: note = a, t, c, g, unknown or other
  misc_difference 237: note = a, t, c, g, unknown or other
  misc_difference 238: note = a, t, c, g, unknown or other
  misc_difference 239: note = a, t, c, g, unknown or other
  misc_difference 240: note = a, t, c, g, unknown or other
  misc_difference 241: note = a, t, c, g, unknown or other
  misc_difference 242: note = a, t, c, g, unknown or other
  misc_difference 243: note = a, t, c, g, unknown or other
  misc_difference 244: note = a, t, c, g, unknown or other
  misc_difference 245: note = a, t, c, g, unknown or other
  misc_difference 246: note = a, t, c, g, unknown or other
  misc_difference 247: note = a, t, c, g, unknown or other
  misc_difference 248: note = a, t, c, g, unknown or other
  misc_difference 249: note = a, t, c, g, unknown or other
  misc_difference 250: note = a, t, c, g, unknown or other
  misc_difference 251: note = a, t, c, g, unknown or other
  misc_difference 252: note = a, t, c, g, unknown or other
  misc_difference 253: note = a, t, c, g, unknown or other
  misc_difference 254: note = a, t, c, g, unknown or other
  misc_difference 255: note = a, t, c, g, unknown or other
  misc_difference 256: note = a, t, c, g, unknown or other
  misc_difference 257: note = a, t, c, g, unknown or other
  misc_difference 258: note = a, t, c, g, unknown or other
  misc_difference 259: note = a, t, c, g, unknown or other
  misc_difference 260: note = a, t, c, g, unknown or other
  misc_difference 261: note = a, t, c, g, unknown or other
  misc_difference 262: note = a, t, c, g, unknown or other
  misc_difference 263: note = a, t, c, g, unknown or other
  misc_difference 264: note = a, t, c, g, unknown or other
  misc_difference 265: note = a, t, c, g, unknown or other
  misc_difference 266: note = a, t, c, g, unknown or other
  misc_difference 267: note = a, t, c, g, unknown or other
  misc_difference 268: note = a, t, c, g, unknown or other
  misc_difference 269: note = a, t, c, g, unknown or other
  misc_difference 270: note = a, t, c, g, unknown or other
  misc_difference 271: note = a, t, c, g, unknown or other
  misc_difference 272: note = a, t, c, g, unknown or other
  misc_difference 273: note = a, t, c, g, unknown or other
  misc_difference 274: note = a, t, c, g, unknown or other
  misc_difference 275: note = a, t, c, g, unknown or other
  misc_difference 276: note = a, t, c, g, unknown or other
  misc_difference 277: note = a, t, c, g, unknown or other
  misc_difference 278: note = a, t, c, g, unknown or other
  misc_difference 279: note = a, t, c, g, unknown or other
  misc_difference 280: note = a, t, c, g, unknown or other
  misc_difference 281: note = a, t, c, g, unknown or other
  misc_difference 282: note = a, t, c, g, unknown or other
  misc_difference 283: note = a, t, c, g, unknown or other
  misc_difference 284: note = a, t, c, g, unknown or other
  misc_difference 285: note = a, t, c, g, unknown or other
  misc_difference 286: note = a, t, c, g, unknown or other
  misc_difference 287: note = a, t, c, g, unknown or other
  misc_difference 288: note = a, t, c, g, unknown or other
  misc_difference 289: note = a, t, c, g, unknown or other
  misc_difference 290: note = a, t, c, g, unknown or other
  misc_difference 291: note = a, t, c, g, unknown or other
  misc_difference 292: note = a, t, c, g, unknown or other
  misc_difference 293: note = a, t, c, g, unknown or other
  misc_difference 294: note = a, t, c, g, unknown or other
  misc_difference 295: note = a, t, c, g, unknown or other
  misc_difference 296: note = a, t, c, g, unknown or other
  misc_difference 297: note = a, t, c, g, unknown or other
  misc_difference 298: note = a, t, c, g, unknown or other
  misc_difference 299: note = a, t, c, g, unknown or other
  misc_difference 300: note = a, t, c, g, unknown or other
  misc_difference 301: note = a, t, c, g, unknown or other
  misc_difference 302: note = a, t, c, g, unknown or other
  misc_difference 303: note = a, t, c, g, unknown or other
  misc_difference 304: note = a, t, c, g, unknown or other
  misc_difference 305: note = a, t, c, g, unknown or other
  misc_difference 306: note = a, t, c, g, unknown or other
  misc_difference 307: note = a, t, c, g, unknown or other
  misc_difference 308: note = a, t, c, g, unknown or other
  misc_difference 309: note = a, t, c, g, unknown or other
  misc_difference 310: note = a, t, c, g, unknown or other
  misc_difference 311: note = a, t, c, g, unknown or other
  misc_difference 312: note = a, t, c, g, unknown or other
  misc_difference 313: note = a, t, c, g, unknown or other
  misc_difference 314: note = a, t, c, g, unknown or other
  misc_difference 315: note = a, t, c, g, unknown or other
  misc_difference 316: note = a, t, c, g, unknown or other
  misc_difference 317: note = a, t, c, g, unknown or other
  misc_difference 318: note = a, t, c, g, unknown or other
  misc_difference 319: note = a, t, c, g, unknown or other
  misc_difference 320: note = a, t, c, g, unknown or other
  misc_difference 321: note = a, t, c, g, unknown or other
  misc_difference 322: note = a, t, c, g, unknown or other
  misc_difference 323: note = a, t, c, g, unknown or other
  misc_difference 324: note = a, t, c, g, unknown or other
  misc_difference 325: note = a, t, c, g, unknown or other
  misc_difference 326: note = a, t, c, g, unknown or other
  misc_difference 327: note = a, t, c, g, unknown or other
  misc_difference 328: note = a, t, c, g, unknown or other
  misc_difference 329: note = a, t, c, g, unknown or other
  misc_difference 330: note = a, t, c, g, unknown or other
  misc_difference 331: note = a, t, c, g, unknown or other
  misc_difference 332: note = a, t, c, g, unknown or other
  misc_difference 333: note = a, t, c, g, unknown or other
  misc_difference 334: note = a, t, c, g, unknown or other
  misc_difference 335: note = a, t, c, g, unknown or other
  misc_difference 336: note = a, t, c, g, unknown or other
  misc_difference 337: note = a, t, c, g, unknown or other
  misc_difference 338: note = a, t, c, g, unknown or other
  misc_difference 339: note = a, t, c, g, unknown or other
  misc_difference 340: note = a, t, c, g, unknown or other
  misc_difference 341: note = a, t, c, g, unknown or other
  misc_difference 342: note = a, t, c, g, unknown or other
  misc_difference 343: note = a, t, c, g, unknown or other
  misc_difference 344: note = a, t, c, g, unknown or other
  misc_difference 345: note = a, t, c, g, unknown or other
  misc_difference 346: note = a, t, c, g, unknown or other
  misc_difference 347: note = a, t, c, g, unknown or other
  misc_difference 348: note = a, t, c, g, unknown or other
  misc_difference 349: note = a, t, c, g, unknown or other
  misc_difference 350: note = a, t, c, g, unknown or other
  misc_difference 351: note = a, t, c, g, unknown or other
  misc_difference 352: note = a, t, c, g, unknown or other
  misc_difference 353: note = a, t, c, g, unknown or other
  misc_difference 354: note = a, t, c, g, unknown or other
  misc_difference 355: note = a, t, c, g, unknown or other
  misc_difference 356: note = a, t, c, g, unknown or other
  misc_difference 357: note = a, t, c, g, unknown or other
  misc_difference 358: note = a, t, c, g, unknown or other
  misc_difference 359: note = a, t, c, g, unknown or other
  misc_difference 360: note = a, t, c, g, unknown or other
  misc_difference 361: note = a, t, c, g, unknown or other
  misc_difference 362: note = a, t, c, g, unknown or other
  misc_difference 363: note = a, t, c, g, unknown or other
  misc_difference 364: note = a, t, c, g, unknown or other
  misc_difference 365: note = a, t, c, g, unknown or other
  misc_difference 366: note = a, t, c, g, unknown or other
  misc_difference 367: note = a, t, c, g, unknown or other
  misc_difference 368: note = a, t, c, g, unknown or other
  misc_difference 369: note = a, t, c, g, unknown or other
  misc_difference 370: note = a, t, c, g, unknown or other
  misc_difference 371: note = a, t, c, g, unknown or other
  misc_difference 372: note = a, t, c, g, unknown or other
  misc_difference 373: note = a, t, c, g, unknown or other
  misc_difference 374: note = a, t, c, g, unknown or other
  misc_difference 375: note = a, t, c, g, unknown or other
  misc_difference 376: note = a, t, c, g, unknown or other
  misc_difference 377: note = a, t, c, g, unknown or other
  misc_difference 378: note = a, t, c, g, unknown or other
  misc_difference 379: note = a, t, c, g, unknown or other
  misc_difference 380: note = a, t, c, g, unknown or other
  misc_difference 381: note = a, t, c, g, unknown or other
  misc_difference 382: note = a, t, c, g, unknown or other
  misc_difference 383: note = a, t, c, g, unknown or other
  misc_difference 384: note = a, t, c, g, unknown or other
  misc_difference 385: note = a, t, c, g, unknown or other
  misc_difference 386: note = a, t, c, g, unknown or other
  misc_difference 387: note = a, t, c, g, unknown or other
  misc_difference 388: note = a, t, c, g, unknown or other
  misc_difference 389: note = a, t, c, g, unknown or other
  misc_difference 390: note = a, t, c, g, unknown or other
  misc_difference 391: note = a, t, c, g, unknown or other
  misc_difference 392: note = a, t, c, g, unknown or other
  misc_difference 393: note = a, t, c, g, unknown or other
  misc_difference 394: note = a, t, c, g, unknown or other
  misc_difference 395: note = a, t, c, g, unknown or other
  misc_difference 396: note = a, t, c, g, unknown or other
  misc_difference 397: note = a, t, c, g, unknown or other
  misc_difference 398: note = a, t, c, g, unknown or other
  misc_difference 399: note = a, t, c, g, unknown or other
  misc_difference 400: note = a, t, c, g, unknown or other
  misc_difference 401: note = a, t, c, g, unknown or other
  misc_difference 402: note = a, t, c, g, unknown or other
  misc_difference 403: note = a, t, c, g, unknown or other
  misc_difference 404: note = a, t, c, g, unknown or other
  misc_difference 405: note = a, t, c, g, unknown or other
  misc_difference 406: note = a, t, c, g, unknown or other
  misc_difference 407: note = a, t, c, g, unknown or other
  misc_difference 408: note = a, t, c, g, unknown or other
  misc_difference 409: note = a, t, c, g, unknown or other
  misc_difference 410: note = a, t, c, g, unknown or other
  misc_difference 411: note = a, t, c, g, unknown or other
  misc_difference 412: note = a, t, c, g, unknown or other
  misc_difference 413: note = a, t, c, g, unknown or other
  misc_difference 414: note = a, t, c, g, unknown or other
  misc_difference 415: note = a, t, c, g, unknown or other
  misc_difference 416: note = a, t, c, g, unknown or other
  misc_difference 417: note = a, t, c, g, unknown or other
  misc_difference 418: note = a, t, c, g, unknown or other
  misc_difference 419: note = a, t, c, g, unknown or other
  misc_difference 420: note = a, t, c, g, unknown or other
  misc_difference 421: note = a, t, c, g, unknown or other
  misc_difference 422: note = a, t, c, g, unknown or other
  misc_difference 423: note = a, t, c, g, unknown or other
  misc_difference 424: note = a, t, c, g, unknown or other
  misc_difference 425: note = a, t, c, g, unknown or other
  misc_difference 426: note = a, t, c, g, unknown or other
  misc_difference 427: note = a, t, c, g, unknown or other
  misc_difference 428: note = a, t, c, g, unknown or other
  misc_difference 429: note = a, t, c, g, unknown or other
  misc_difference 430: note = a, t, c, g, unknown or other
  misc_difference 431: note = a, t, c, g, unknown or other
  misc_difference 432: note = a, t, c, g, unknown or other
  misc_difference 433: note = a, t, c, g, unknown or other
  misc_difference 434: note = a, t, c, g, unknown or other
  misc_difference 435: note = a, t, c, g, unknown or other
  misc_difference 436: note = a, t, c, g, unknown or other
  misc_difference 437: note = a, t, c, g, unknown or other
  misc_difference 438: note = a, t, c, g, unknown or other
  misc_difference 439: note = a, t, c, g, unknown or other
  misc_difference 440: note = a, t, c, g, unknown or other
  misc_difference 441: note = a, t, c, g, unknown or other
  misc_difference 442: note = a, t, c, g, unknown or other
  misc_difference 443: note = a, t, c, g, unknown or other
  misc_difference 444: note = a, t, c, g, unknown or other
  misc_difference 445: note = a, t, c, g, unknown or other
  misc_difference 446: note = a, t, c, g, unknown or other
  misc_difference 447: note = a, t, c, g, unknown or other
  misc_difference 448: note = a, t, c, g, unknown or other
  misc_difference 449: note = a, t, c, g, unknown or other
  misc_difference 450: note = a, t, c, g, unknown or other
  misc_difference 451: note = a, t, c, g, unknown or other
  misc_difference 452: note = a, t, c, g, unknown or other
  misc_difference 453: note = a, t, c, g, unknown or other
  misc_difference 454: note = a, t, c, g, unknown or other
  misc_difference 455: note = a, t, c, g, unknown or other
  misc_difference 456: note = a, t, c, g, unknown or other
  misc_difference 457: note = a, t, c, g, unknown or other
  misc_difference 458: note = a, t, c, g, unknown or other
  misc_difference 459: note = a, t, c, g, unknown or other
  misc_difference 460: note = a, t, c, g, unknown or other
  misc_difference 461: note = a, t, c, g, unknown or other
  misc_difference 462: note = a, t, c, g, unknown or other
  misc_difference 463: note = a, t, c, g, unknown or other
  misc_difference 464: note = a, t, c, g, unknown or other
  misc_difference 465: note = a, t, c, g, unknown or other
  misc_difference 466: note = a, t, c, g, unknown or other
  misc_difference 467: note = a, t, c, g, unknown or other
  misc_difference 468: note = a, t, c, g, unknown or other
  misc_difference 469: note = a, t, c, g, unknown or other
  misc_difference 470: note = a, t, c, g, unknown or other
  misc_difference 471: note = a, t, c, g, unknown or other
  misc_difference 472: note = a, t, c, g, unknown or other
  misc_difference 473: note = a, t, c, g, unknown or other
  misc_difference 474: note = a, t, c, g, unknown or other
  misc_difference 475: note = a, t, c, g, unknown or other
  misc_difference 476: note = a, t, c, g, unknown or other
  misc_difference 477: note = a, t, c, g, unknown or other
  misc_difference 478: note = a, t, c, g, unknown or other
  misc_difference 479: note = a, t, c, g, unknown or other
  misc_difference 480: note = a, t, c, g, unknown or other
  misc_difference 481: note = a, t, c, g, unknown or other
  misc_difference 482: note = a, t, c, g, unknown or other
  misc_difference 483: note = a, t, c, g, unknown or other
  misc_difference 484: note = a, t, c, g, unknown or other
  misc_difference 485: note = a, t, c, g, unknown or other
  misc_difference 486: note = a, t, c, g, unknown or other
  misc_difference 487: note = a, t, c, g, unknown or other
  misc_difference 488: note = a, t, c, g, unknown or other
  misc_difference 489: note = a, t, c, g, unknown or other
  misc_difference 490: note = a, t, c, g, unknown or other
  misc_difference 491: note = a, t, c, g, unknown or other
  misc_difference 492: note = a, t, c, g, unknown or other
  misc_difference 493: note = a, t, c, g, unknown or other
  misc_difference 494: note = a, t, c, g, unknown or other
  misc_difference 495: note = a, t, c, g, unknown or other
  misc_difference 496: note = a, t, c, g, unknown or other
  misc_difference 497: note = a, t, c, g, unknown or other
  misc_difference 498: note = a, t, c, g, unknown or other
  misc_difference 499: note = a, t, c, g, unknown or other
  misc_difference 500: note = a, t, c, g, unknown or other
  misc_difference 501: note = a, t, c, g, unknown or other
  misc_difference 502: note = a, t, c, g, unknown or other
  misc_difference 503: note = a, t, c, g, unknown or other
  misc_difference 504: note = a, t, c, g, unknown or other
  misc_difference 505: note = a, t, c, g, unknown or other
  misc_difference 506: note = a, t, c, g, unknown or other
  misc_difference 507: note = a, t, c, g, unknown or other
  misc_difference 508: note = a, t, c, g, unknown or other
  misc_difference 509: note = a, t, c, g, unknown or other
  misc_difference 510: note = a, t, c, g, unknown or other
  misc_difference 511: note = a, t, c, g, unknown or other
  misc_difference 512: note = a, t, c, g, unknown or other
  misc_difference 513: note = a, t, c, g, unknown or other
  misc_difference 514: note = a, t, c, g, unknown or other
  misc_difference 515: note = a, t, c, g, unknown or other
  misc_difference 516: note = a, t, c, g, unknown or other
  misc_difference 517: note = a, t, c, g, unknown or other
  misc_difference 518: note = a, t, c, g, unknown or other
  misc_difference 519: note = a, t, c, g, unknown or other
  misc_difference 520: note = a, t, c, g, unknown or other
  misc_difference 521: note = a, t, c, g, unknown or other
  misc_difference 522: note = a, t, c, g, unknown or other
  misc_difference 523: note = a, t, c, g, unknown or other
  misc_difference 524: note = a, t, c, g, unknown or other
  misc_difference 525: note = a, t, c, g, unknown or other
  misc_difference 526: note = a, t, c, g, unknown or other
  misc_difference 527: note = a, t, c, g, unknown or other
  misc_difference 528: note = a, t, c, g, unknown or other
  misc_difference 529: note = a, t, c, g, unknown or other
  misc_difference 530: note = a, t, c, g, unknown or other
  misc_difference 531: note = a, t, c, g, unknown or other
  misc_difference 532: note = a, t, c, g, unknown or other
  misc_difference 533: note = a, t, c, g, unknown or other
  misc_difference 534: note = a, t, c, g, unknown or other
  misc_difference 535: note = a, t, c, g, unknown or other
  misc_difference 536: note = a, t, c, g, unknown or other
  misc_difference 537: note = a, t, c, g, unknown or other
  misc_difference 538: note = a, t, c, g, unknown or other
  misc_difference 539: note = a, t, c, g, unknown or other
  misc_difference 540: note = a, t, c, g, unknown or other
  misc_difference 541: note = a, t, c, g, unknown or other
  misc_difference 542: note = a, t, c, g, unknown or other
  misc_difference 543: note = a, t, c, g, unknown or other
  misc_difference 544: note = a, t, c, g, unknown or other
  misc_difference 545: note = a, t, c, g, unknown or other
  misc_difference 546: note = a, t, c, g, unknown or other
  misc_difference 547: note = a, t, c, g, unknown or other
  misc_difference 548: note = a, t, c, g, unknown or other
  misc_difference 549: note = a, t, c, g, unknown or other
  misc_difference 550: note = a, t, c, g, unknown or other
  misc_difference 551: note = a, t, c, g, unknown or other
  misc_difference 552: note = a, t, c, g, unknown or other
  misc_difference 553: note = a, t, c, g, unknown or other
  misc_difference 554: note = a, t, c, g, unknown or other
  misc_difference 555: note = a, t, c, g, unknown or other
  misc_difference 556: note = a, t, c, g, unknown or other
  misc_difference 557: note = a, t, c, g, unknown or other
  misc_difference 558: note = a, t, c, g, unknown or other
  misc_difference 559: note = a, t, c, g, unknown or other
  misc_difference 560: note = a, t, c, g, unknown or other
  misc_difference 561: note = a, t, c, g, unknown or other
  misc_difference 562: note = a, t, c, g, unknown or other
  misc_difference 563: note = a, t, c, g, unknown or other
  misc_difference 564: note = a, t, c, g, unknown or other
  misc_difference 565: note = a, t, c, g, unknown or other
  misc_difference 566: note = a, t, c, g, unknown or other
  misc_difference 567: note = a, t, c, g, unknown or other
  misc_difference 568: note = a, t, c, g, unknown or other
  misc_difference 569: note = a, t, c, g, unknown or other
  misc_difference 570: note = a, t, c, g, unknown or other
  misc_difference 571: note = a, t, c, g, unknown or other
  misc_difference 572: note = a, t, c, g, unknown or other
  misc_difference 573: note = a, t, c, g, unknown or other
  misc_difference 574: note = a, t, c, g, unknown or other
  misc_difference 575: note = a, t, c, g, unknown or other
  misc_difference 576: note = a, t, c, g, unknown or other
  misc_difference 577: note = a, t, c, g, unknown or other
  misc_difference 578: note = a, t, c, g, unknown or other
  misc_difference 579: note = a, t, c, g, unknown or other
  misc_difference 580: note = a, t, c, g, unknown or other
  misc_difference 581: note = a, t, c, g, unknown or other
  misc_difference 582: note = a, t, c, g, unknown or other
  misc_difference 583: note = a, t, c, g, unknown or other
  misc_difference 584: note = a, t, c, g, unknown or other
  misc_difference 585: note = a, t, c, g, unknown or other
  misc_difference 586: note = a, t, c, g, unknown or other
  misc_difference 587: note = a, t, c, g, unknown or other
  misc_difference 588: note = a, t, c, g, unknown or other
  misc_difference 589: note = a, t, c, g, unknown or other
  misc_difference 590: note = a, t, c, g, unknown or other
  misc_difference 591: note = a, t, c, g, unknown or other
  misc_difference 592: note = a, t, c, g, unknown or other
  misc_difference 593: note = a, t, c, g, unknown or other
  misc_difference 594: note = a, t, c, g, unknown or other
  misc_difference 595: note = a, t, c, g, unknown or other
  misc_difference 596: note = a, t, c, g, unknown or other
  misc_difference 597: note = a, t, c, g, unknown or other
  misc_difference 598: note = a, t, c, g, unknown or other
  misc_difference 599: note = a, t, c, g, unknown or other
  misc_difference 600: note = a, t, c, g, unknown or other
  misc_difference 601: note = a, t, c, g, unknown or other
  misc_difference 602: note = a, t, c, g, unknown or other
  misc_difference 603: note = a, t, c, g, unknown or other
  misc_difference 604: note = a, t, c, g, unknown or other
  misc_difference 605: note = a, t, c, g, unknown or other
  misc_difference 606: note = a, t, c, g, unknown or other
  misc_difference 607: note = a, t, c, g, unknown or other
  misc_difference 608: note = a, t, c, g, unknown or other
  misc_difference 609: note = a, t, c, g, unknown or other
  misc_difference 610: note = a, t, c, g, unknown or other
  misc_difference 611: note = a, t, c, g, unknown or other
  misc_difference 612: note = a, t, c, g, unknown or other
  misc_difference 613: note = a, t, c, g, unknown or other
  misc_difference 614: note = a, t, c, g, unknown or other
  misc_difference 615: note = a, t, c, g, unknown or other
  misc_difference 616: note = a, t, c, g, unknown or other
  misc_difference 617: note = a, t, c, g, unknown or other
  misc_difference 618: note = a, t, c, g, unknown or other
  misc_difference 619: note = a, t, c, g, unknown or other
  misc_difference 620: note = a, t, c, g, unknown or other
  misc_difference 621: note = a, t, c, g, unknown or other
  misc_difference 622: note = a, t, c, g, unknown or other
  misc_difference 623: note = a, t, c, g, unknown or other
  misc_difference 624: note = a, t, c, g, unknown or other
  misc_difference 625: note = a, t, c, g, unknown or other
  misc_difference 626: note = a, t, c, g, unknown or other
  misc_difference 627: note = a, t, c, g, unknown or other
  misc_difference 628: note = a, t, c, g, unknown or other
  misc_difference 629: note = a, t, c, g, unknown or other
  misc_difference 630: note = a, t, c, g, unknown or other
  misc_difference 631: note = a, t, c, g, unknown or other
  misc_difference 632: note = a, t, c, g, unknown or other
  misc_difference 633: note = a, t, c, g, unknown or other
  misc_difference 634: note = a, t, c, g, unknown or other
  misc_difference 635: note = a, t, c, g, unknown or other
  misc_difference 636: note = a, t, c, g, unknown or other
  misc_difference 637: note = a, t, c, g, unknown or other
  misc_difference 638: note = a, t, c, g, unknown or other
  misc_difference 639: note = a, t, c, g, unknown or other
  misc_difference 640: note = a, t, c, g, unknown or other
  misc_difference 641: note = a, t, c, g, unknown or other
  misc_difference 642: note = a, t, c, g, unknown or other
  misc_difference 643: note = a, t, c, g, unknown or other
  misc_difference 644: note = a, t, c, g, unknown or other
  misc_difference 645: note = a, t, c, g, unknown or other
  misc_difference 646: note = a, t, c, g, unknown or other
  misc_difference 647: note = a, t, c, g, unknown or other
  misc_difference 648: note = a, t, c, g, unknown or other
  misc_difference 649: note = a, t, c, g, unknown or other
  misc_difference 650: note = a, t, c, g, unknown or other
  misc_difference 651: note = a, t, c, g, unknown or other
  misc_difference 652: note = a, t, c, g, unknown or other
  misc_difference 653: note = a, t, c, g, unknown or other
  misc_difference 654: note = a, t, c, g, unknown or other
  misc_difference 655: note = a, t, c, g, unknown or other
  misc_difference 656: note = a, t, c, g, unknown or other
  misc_difference 657: note = a, t, c, g, unknown or other
  misc_difference 658: note = a, t, c, g, unknown or other
  misc_difference 659: note = a, t, c, g, unknown or other
  misc_difference 660: note = a, t, c, g, unknown or other
  misc_difference 661: note = a, t, c, g, unknown or other
  misc_difference 662: note = a, t, c, g, unknown or other
  misc_difference 663: note = a, t, c, g, unknown or other
  misc_difference 664: note = a, t, c, g, unknown or other
  misc_difference 665: note = a, t, c, g, unknown or other
  misc_difference 666: note = a, t, c, g, unknown or other
  misc_difference 667: note = a, t, c, g, unknown or other
  misc_difference 668: note = a, t, c, g, unknown or other
  misc_difference 669: note = a, t, c, g, unknown or other
  misc_difference 670: note = a, t, c, g, unknown or other
  misc_difference 671: note = a, t, c, g, unknown or other
  misc_difference 672: note = a, t, c, g, unknown or other
  misc_difference 673: note = a, t, c, g, unknown or other
  misc_difference 674: note = a, t, c, g, unknown or other
  misc_difference 675: note = a, t, c, g, unknown or other
  misc_difference 676: note = a, t, c, g, unknown or other
  misc_difference 677: note = a, t, c, g, unknown or other
  misc_difference 678: note = a, t, c, g, unknown or other
  misc_difference 679: note = a, t, c, g, unknown or other
  misc_difference 680: note = a, t, c, g, unknown or other
  misc_difference 681: note = a, t, c, g, unknown or other
  misc_difference 682: note = a, t, c, g, unknown or other
  misc_difference 683: note = a, t, c, g, unknown or other
  misc_difference 684: note = a, t, c, g, unknown or other
  misc_difference 685: note = a, t, c, g, unknown or other
  misc_difference 686: note = a, t, c, g, unknown or other
  misc_difference 687: note = a, t, c, g, unknown or other
  misc_difference 688: note = a, t, c, g, unknown or other
  misc_difference 689: note = a, t, c, g, unknown or other
  misc_difference 690: note = a, t, c, g, unknown or other
  misc_difference 691: note = a, t, c, g, unknown or other
  misc_difference 692: note = a, t, c, g, unknown or other
  misc_difference 693: note = a, t, c, g, unknown or other
  misc_difference 694: note = a, t, c, g, unknown or other
  misc_difference 695: note = a, t, c, g, unknown or other
  misc_difference 696: note = a, t, c, g, unknown or other
  misc_difference 697: note = a, t, c, g, unknown or other
  misc_difference 698: note = a, t, c, g, unknown or other
  misc_difference 699: note = a, t, c, g, unknown or other
  misc_difference 700: note = a, t, c, g, unknown or other
  misc_difference 701: note = a, t, c, g, unknown or other
  misc_difference 702: note = a, t, c, g, unknown or other
  misc_difference 703: note = a, t, c, g, unknown or other
  misc_difference 704: note = a, t, c, g, unknown or other
  misc_difference 705: note = a, t, c, g, unknown or other
  misc_difference 706: note = a, t, c, g, unknown or other
  misc_difference 707: note = a, t, c, g, unknown or other
  misc_difference 708: note = a, t, c, g, unknown or other
  misc_difference 709: note = a, t, c, g, unknown or other
  misc_difference 710: note = a, t, c, g, unknown or other
  misc_difference 711: note = a, t, c, g, unknown or other
  misc_difference 712: note = a, t, c, g, unknown or other
  misc_difference 713: note = a, t, c, g, unknown or other
  misc_difference 714: note = a, t, c, g, unknown or other
  misc_difference 715: note = a, t, c, g, unknown or other
  misc_difference 716: note = a, t, c, g, unknown or other
  misc_difference 717: note = a, t, c, g, unknown or other
  misc_difference 718: note = a, t, c, g, unknown or other
  misc_difference 719: note = a, t, c, g, unknown or other
  misc_difference 720: note = a, t, c, g, unknown or other
  misc_difference 721: note = a, t, c, g, unknown or other
  misc_difference 722: note = a, t, c, g, unknown or other
  misc_difference 723: note = a, t, c, g, unknown or other
  misc_difference 724: note = a, t, c, g, unknown or other
  misc_difference 725: note = a, t, c, g, unknown or other
  misc_difference 726: note = a, t, c, g, unknown or other
  misc_difference 727: note = a, t, c, g, unknown or other
  misc_difference 728: note = a, t, c, g, unknown or other
  misc_difference 729: note = a, t, c, g, unknown or other
  misc_difference 730: note = a, t, c, g, unknown or other
  misc_difference 731: note = a, t, c, g, unknown or other
  misc_difference 732: note = a, t, c, g, unknown or other
  misc_difference 733: note = a, t, c, g, unknown or other
  misc_difference 734: note = a, t, c, g, unknown or other
  misc_difference 735: note = a, t, c, g, unknown or other
  misc_difference 736: note = a, t, c, g, unknown or other
  misc_difference 737: note = a, t, c, g, unknown or other
  misc_difference 738: note = a, t, c, g, unknown or other
  misc_difference 739: note = a, t, c, g, unknown or other
  misc_difference 740: note = a, t, c, g, unknown or other
  misc_difference 741: note = a, t, c, g, unknown or other
  misc_difference 742: note = a, t, c, g, unknown or other
  misc_difference 743: note = a, t, c, g, unknown or other
  misc_difference 744: note = a, t, c, g, unknown or other
  misc_difference 745: note = a, t, c, g, unknown or other
  misc_difference 746: note = a, t, c, g, unknown or other
  misc_difference 747: note = a, t, c, g, unknown or other
  misc_difference 748: note = a, t, c, g, unknown or other
  misc_difference 749: note = a, t, c, g, unknown or other
  misc_difference 750: note = a, t, c, g, unknown or other
  misc_difference 751: note = a, t, c, g, unknown or other
  misc_difference 752: note = a, t, c, g, unknown or other
  misc_difference 753: note = a, t, c, g, unknown or other
  misc_difference 754: note = a, t, c, g, unknown or other
  misc_difference 755: note = a, t, c, g, unknown or other
  misc_difference 756: note = a, t, c, g, unknown or other
  misc_difference 757: note = a, t, c, g, unknown or other
  misc_difference 758: note = a, t, c, g, unknown or other
  misc_difference 759: note = a, t, c, g, unknown or other
  misc_difference 760: note = a, t, c, g, unknown or other
  misc_difference 761: note = a, t, c, g, unknown or other
  misc_difference 762: note = a, t, c, g, unknown or other
  misc_difference 763: note = a, t, c, g, unknown or other
  misc_difference 764: note = a, t, c, g, unknown or other
  misc_difference 765: note = a, t, c, g, unknown or other
  misc_difference 766: note = a, t, c, g, unknown or other
  misc_difference 767: note = a, t, c, g, unknown or other
  misc_difference 768: note = a, t, c, g, unknown or other
  misc_difference 769: note = a, t, c, g, unknown or other
  misc_difference 770: note = a, t, c, g, unknown or other
  misc_difference 771: note = a, t, c, g, unknown or other
  misc_difference 772: note = a, t, c, g, unknown or other
  misc_difference 773: note = a, t, c, g, unknown or other
  misc_difference 774: note = a, t, c, g, unknown or other
  misc_difference 775: note = a, t, c, g, unknown or other
  misc_difference 776: note = a, t, c, g, unknown or other
  misc_difference 777: note = a, t, c, g, unknown or other
  misc_difference 778: note = a, t, c, g, unknown or other
  misc_difference 779: note = a, t, c, g, unknown or other
  misc_difference 780: note = a, t, c, g, unknown or other
  misc_difference 781: note = a, t, c, g, unknown or other
  misc_difference 782: note = a, t, c, g, unknown or other
  misc_difference 783: note = a, t, c, g, unknown or other
  misc_difference 784: note = a, t, c, g, unknown or other
  misc_difference 785: note = a, t, c, g, unknown or other
  misc_difference 786: note = a, t, c, g, unknown or other
  misc_difference 787: note = a, t, c, g, unknown or other
  misc_difference 788: note = a, t, c, g, unknown or other
  misc_difference 789: note = a, t, c, g, unknown or other
  misc_difference 790: note = a, t, c, g, unknown or other
  misc_difference 791: note = a, t, c, g, unknown or other
  misc_difference 792: note = a, t, c, g, unknown or other
  misc_difference 793: note = a, t, c, g, unknown or other
  misc_difference 794: note = a, t, c, g, unknown or other
  misc_difference 795: note = a, t, c, g, unknown or other
  misc_difference 796: note = a, t, c, g, unknown or other
  misc_difference 797: note = a, t, c, g, unknown or other
  misc_difference 798: note = a, t, c, g, unknown or other
  misc_difference 799: note = a, t, c, g, unknown or other
  misc_difference 800: note = a, t, c, g, unknown or other
  misc_difference 801: note = a, t, c, g, unknown or other
  misc_difference 802: note = a, t, c, g, unknown or other
  misc_difference 803: note = a, t, c, g, unknown or other
  misc_difference 804: note = a, t, c, g, unknown or other
  misc_difference 805: note = a, t, c, g, unknown or other
  misc_difference 806: note = a, t, c, g, unknown or other
  misc_difference 807: note = a, t, c, g, unknown or other
  misc_difference 808: note = a, t, c, g, unknown or other
  misc_difference 809: note = a, t, c, g, unknown or other
  misc_difference 810: note = a, t, c, g, unknown or other
  misc_difference 811: note = a, t, c, g, unknown or other
  misc_difference 812: note = a, t, c, g, unknown or other
  misc_difference 813: note = a, t, c, g, unknown or other
  misc_difference 814: note = a, t, c, g, unknown or other
  misc_difference 815: note = a, t, c, g, unknown or other
  misc_difference 816: note = a, t, c, g, unknown or other
  misc_difference 817: note = a, t, c, g, unknown or other
  misc_difference 818: note = a, t, c, g, unknown or other
  misc_difference 819: note = a, t, c, g, unknown or other
  misc_difference 820: note = a, t, c, g, unknown or other
  misc_difference 821: note = a, t, c, g, unknown or other
  misc_difference 822: note = a, t, c, g, unknown or other
  misc_difference 823: note = a, t, c, g, unknown or other
  misc_difference 824: note = a, t, c, g, unknown or other
  misc_difference 825: note = a, t, c, g, unknown or other
  misc_difference 826: note = a, t, c, g, unknown or other
  misc_difference 827: note = a, t, c, g, unknown or other
  misc_difference 828: note = a, t, c, g, unknown or other
  misc_difference 829: note = a, t, c, g, unknown or other
  misc_difference 830: note = a, t, c, g, unknown or other
  misc_difference 831: note = a, t, c, g, unknown or other
  misc_difference 832: note = a, t, c, g, unknown or other
  misc_difference 833: note = a, t, c, g, unknown or other
  misc_difference 834: note = a, t, c, g, unknown or other
  misc_difference 835: note = a, t, c, g, unknown or other
  misc_difference 836: note = a, t, c, g, unknown or other
  misc_difference 837: note = a, t, c, g, unknown or other
  misc_difference 838: note = a, t, c, g, unknown or other
  misc_difference 839: note = a, t, c, g, unknown or other
  misc_difference 840: note = a, t, c, g, unknown or other
  misc_difference 841: note = a, t, c, g, unknown or other
  misc_difference 842: note = a, t, c, g, unknown or other
  misc_difference 843: note = a, t, c, g, unknown or other
  misc_difference 844: note = a, t, c, g, unknown or other
  misc_difference 845: note = a, t, c, g, unknown or other
  misc_difference 846: note = a, t, c, g, unknown or other
  misc_difference 847: note = a, t, c, g, unknown or other
  misc_difference 848: note = a, t, c, g, unknown or other
  misc_difference 849: note = a, t, c, g, unknown or other
  misc_difference 850: note = a, t, c, g, unknown or other
  misc_difference 851: note = a, t, c, g, unknown or other
  misc_difference 852: note = a, t, c, g, unknown or other
  misc_difference 853: note = a, t, c, g, unknown or other
  misc_difference 854: note = a, t, c, g, unknown or other
  misc_difference 855: note = a, t, c, g, unknown or other
  misc_difference 856: note = a, t, c, g, unknown or other
  misc_difference 857: note = a, t, c, g, unknown or other
  misc_difference 858: note = a, t, c, g, unknown or other
  misc_difference 859: note = a, t, c, g, unknown or other
  misc_difference 860: note = a, t, c, g, unknown or other
  misc_difference 861: note = a, t, c, g, unknown or other
  misc_difference 862: note = a, t, c, g, unknown or other
  misc_difference 863: note = a, t, c, g, unknown or other
  misc_difference 864: note = a, t, c, g, unknown or other
  misc_difference 865: note = a, t, c, g, unknown or other
  misc_difference 866: note = a, t, c, g, unknown or other
  misc_difference 867: note = a, t, c, g, unknown or other
  misc_difference 868: note = a, t, c, g, unknown or other
  misc_difference 869: note = a, t, c, g, unknown or other
  misc_difference 870: note = a, t, c, g, unknown or other
  misc_difference 871: note = a, t, c, g, unknown or other
  misc_difference 872: note = a, t, c, g, unknown or other
  misc_difference 873: note = a, t, c, g, unknown or other
  misc_difference 874: note = a, t, c, g, unknown or other
  misc_difference 875: note = a, t, c, g, unknown or other
  misc_difference 876: note = a, t, c, g, unknown or other
  misc_difference 877: note = a, t, c, g, unknown or other
  misc_difference 878: note = a, t, c, g, unknown or other
  misc_difference 879: note = a, t, c, g, unknown or other
  misc_difference 880: note = a, t, c, g, unknown or other
  misc_difference 881: note = a, t, c, g, unknown or other
  misc_difference 882: note = a, t, c, g, unknown or other
  misc_difference 883: note = a, t, c, g, unknown or other
  misc_difference 884: note = a, t, c, g, unknown or other
  misc_difference 885: note = a, t, c, g, unknown or other
  misc_difference 886: note = a, t, c, g, unknown or other
  misc_difference 887: note = a, t, c, g, unknown or other
  misc_difference 888: note = a, t, c, g, unknown or other
  misc_difference 889: note = a, t, c, g, unknown or other
  misc_difference 890: note = a, t, c, g, unknown or other
  misc_difference 891: note = a, t, c, g, unknown or other
  misc_difference 892: note = a, t, c, g, unknown or other
  misc_difference 893: note = a, t, c, g, unknown or other
  misc_difference 894: note = a, t, c, g, unknown or other
  misc_difference 895: note = a, t, c, g, unknown or other
  misc_difference 896: note = a, t, c, g, unknown or other
  misc_difference 897: note = a, t, c, g, unknown or other
  misc_difference 898: note = a, t, c, g, unknown or other
  misc_difference 899: note = a, t, c, g, unknown or other
  misc_difference 900: note = a, t, c, g, unknown or other
  misc_difference 901: note = a, t, c, g, unknown or other
  misc_difference 902: note = a, t, c, g, unknown or other
  misc_difference 903: note = a, t, c, g, unknown or other
  misc_difference 904: note = a, t, c, g, unknown or other
  misc_difference 905: note = a, t, c, g, unknown or other
  misc_difference 906: note = a, t, c, g, unknown or other
  misc_difference 907: note = a, t, c, g, unknown or other
  misc_difference 908: note = a, t, c, g, unknown or other
  misc_difference 909: note = a, t, c, g, unknown or other
  misc_difference 910: note = a, t, c, g, unknown or other
  misc_difference 911: note = a, t, c, g, unknown or other
  misc_difference 912: note = a, t, c, g, unknown or other
  misc_difference 913: note = a, t, c, g, unknown or other
  misc_difference 914: note = a, t, c, g, unknown or other
  misc_difference 915: note = a, t, c, g, unknown or other
  misc_difference 916: note = a, t, c, g, unknown or other
  misc_difference 917: note = a, t, c, g, unknown or other
  misc_difference 918: note = a, t, c, g, unknown or other
  misc_difference 919: note = a, t, c, g, unknown or other
  misc_difference 920: note = a, t, c, g, unknown or other
  misc_difference 921: note = a, t, c, g, unknown or other
  misc_difference 922: note = a, t, c, g, unknown or other
  misc_difference 923: note = a, t, c, g, unknown or other
  misc_difference 924: note = a, t, c, g, unknown or other
  misc_difference 925: note = a, t, c, g, unknown or other
  misc_difference 926: note = a, t, c, g, unknown or other
  misc_difference 927: note = a, t, c, g, unknown or other
  misc_difference 928: note = a, t, c, g, unknown or other
  misc_difference 929: note = a, t, c, g, unknown or other
  misc_difference 930: note = a, t, c, g, unknown or other
  misc_difference 931: note = a, t, c, g, unknown or other
  misc_difference 932: note = a, t, c, g, unknown or other
  misc_difference 933: note = a, t, c, g, unknown or other
  misc_difference 934: note = a, t, c, g, unknown or other
  misc_difference 935: note = a, t, c, g, unknown or other
  misc_difference 936: note = a, t, c, g, unknown or other
  misc_difference 937: note = a, t, c, g, unknown or other
  misc_difference 938: note = a, t, c, g, unknown or other
  misc_difference 939: note = a, t, c, g, unknown or other
  misc_difference 940: note = a, t, c, g, unknown or other
  misc_difference 941: note = a, t, c, g, unknown or other
  misc_difference 942: note = a, t, c, g, unknown or other
  misc_difference 943: note = a, t, c, g, unknown or other
  misc_difference 944: note = a, t, c, g, unknown or other
  misc_difference 945: note = a, t, c, g, unknown or other
  misc_difference 946: note = a, t, c, g, unknown or other
  misc_difference 947: note = a, t, c, g, unknown or other
  misc_difference 948: note = a, t, c, g, unknown or other
  misc_difference 949: note = a, t, c, g, unknown or other
  misc_difference 950: note = a, t, c, g, unknown or other
  misc_difference 951: note = a, t, c, g, unknown or other
  misc_difference 952: note = a, t, c, g, unknown or other
  misc_difference 953: note = a, t, c, g, unknown or other
  misc_difference 954: note = a, t, c, g, unknown or other
  misc_difference 955: note = a, t, c, g, unknown or other
  misc_difference 956: note = a, t, c, g, unknown or other
  misc_difference 957: note = a, t, c, g, unknown or other
  misc_difference 958: note = a, t, c, g, unknown or other
  misc_difference 959: note = a, t, c, g, unknown or other
  misc_difference 960: note = a, t, c, g, unknown or other
  misc_difference 961: note = a, t, c, g, unknown or other
  misc_difference 962: note = a, t, c, g, unknown or other
  misc_difference 963: note = a, t, c, g, unknown or other
  misc_difference 964: note = a, t, c, g, unknown or other
  misc_difference 965: note = a, t, c, g, unknown or other
  misc_difference 966: note = a, t, c, g, unknown or other
  misc_difference 967: note = a, t, c, g, unknown or other
  misc_difference 968: note = a, t, c, g, unknown or other
  misc_difference 969: note = a, t, c, g, unknown or other
  misc_difference 970: note = a, t, c, g, unknown or other
  misc_difference 971: note = a, t, c, g, unknown or other
  misc_difference 972: note = a, t, c, g, unknown or other
  misc_difference 973: note = a, t, c, g, unknown or other
  misc_difference 974: note = a, t, c, g, unknown or other
  misc_difference 975: note = a, t, c, g, unknown or other
  misc_difference 976: note = a, t, c, g, unknown or other
  misc_difference 977: note = a, t, c, g, unknown or other
  misc_difference 978: note = a, t, c, g, unknown or other
  misc_difference 979: note = a, t, c, g, unknown or other
  misc_difference 980: note = a, t, c, g, unknown or other
  misc_difference 981: note = a, t, c, g, unknown or other
  misc_difference 982: note = a, t, c, g, unknown or other
  misc_difference 983: note = a, t, c, g, unknown or other
  misc_difference 984: note = a, t, c, g, unknown or other
  misc_difference 985: note = a, t, c, g, unknown or other
  misc_difference 986: note = a, t, c, g, unknown or other
  misc_difference 987: note = a, t, c, g, unknown or other
  misc_difference 988: note = a, t, c, g, unknown or other
  misc_difference 989: note = a, t, c, g, unknown or other
  misc_difference 990: note = a, t, c, g, unknown or other
  misc_difference 991: note = a, t, c, g, unknown or other
  misc_difference 992: note = a, t, c, g, unknown or other
  misc_difference 993: note = a, t, c, g, unknown or other
  misc_difference 994: note = a, t, c, g, unknown or other
  misc_difference 995: note = a, t, c, g, unknown or other
  misc_difference 996: note = a, t, c, g, unknown or other
  misc_difference 997: note = a, t, c, g, unknown or other
  misc_difference 998: note = a, t, c, g, unknown or other
  misc_difference 999: note = a, t, c, g, unknown or other
  misc_difference 1000: note = a, t, c, g, unknown or other
  misc_difference 1001..1014: note = a, t, c, g, unknown or other
  modified_base 1039: mod_base = OTHER; note = hydroxy thymidine
tgacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtactgactgtagggctggcgacct

SEQ ID NO: 5 - DNA, 23 bp, synthetic construct
  source 1..23: mol_type = other DNA
  misc_difference 1: note = a, t, c, g, unknown or other
  misc_difference 2: note = a, t, c, g, unknown or other
  misc_difference 3: note = a, t, c, g, unknown or other
  misc_difference 4: note = a, t, c, g, unknown or other
  modified_base 23: mod_base = OTHER; note = hydroxy cytidine
nnnntcgtcaaggtcgccagccc

SEQ ID NO: 6 - DNA, 1019 bp, synthetic construct
  source 1..1019: mol_type = other DNA
  modified_base 1: mod_base = OTHER; note = Phosphate adenosine
  misc_difference 12: note = a, t, c, g, unknown or other
  misc_difference 13: note = a, t, c, g, unknown or other
  misc_difference 14: note = a, t, c, g, unknown or other
  misc_difference 15: note = a, t, c, g, unknown or other
  misc_difference 16: note = a, t, c, g, unknown or other
  misc_difference 17: note = a, t, c, g, unknown or other
  misc_difference 18: note = a, t, c, g, unknown or other
  misc_difference 19: note = a, t, c, g, unknown or other
  misc_difference 20: note = a, t, c, g, unknown or other
  misc_difference 21: note = a, t, c, g, unknown or other
  misc_difference 22: note = a, t, c, g, unknown or other
  misc_difference 23: note = a, t, c, g, unknown or other
  misc_difference 24: note = a, t, c, g, unknown or other
  misc_difference 25: note = a, t, c, g, unknown or other
  misc_difference 26: note = a, t, c, g, unknown or other
  misc_difference 27: note = a, t, c, g, unknown or other
  misc_difference 28: note = a, t, c, g, unknown or other
  misc_difference 29: note = a, t, c, g, unknown or other
  misc_difference 30: note = a, t, c, g, unknown or other
  misc_difference 31: note = a, t, c, g, unknown or other
  misc_difference 32: note = a, t, c, g, unknown or other
  misc_difference 33: note = a, t, c, g, unknown or other
  misc_difference 34: note = a, t, c, g, unknown or other
  misc_difference 35: note = a, t, c, g, unknown or other
  misc_difference 36: note = a, t, c, g, unknown or other
  misc_difference 37: note = a, t, c, g, unknown or other
  misc_difference 38: note = a, t, c, g, unknown or other
  misc_difference 39: note = a, t, c, g, unknown or other
  misc_difference 40: note = a, t, c, g, unknown or other
  misc_difference 41: note = a, t, c, g, unknown or other
  misc_difference 42: note = a, t, c, g, unknown or other
  misc_difference 43: note = a, t, c, g, unknown or other
  misc_difference 44: note = a, t, c, g, unknown or other
  misc_difference 45: note = a, t, c, g, unknown or other
  misc_difference 46: note = a, t, c, g, unknown or other
  misc_difference 47: note = a, t, c, g, unknown or other
  misc_difference 48: note = a, t, c, g, unknown or other
  misc_difference 49: note = a, t, c, g, unknown or other
  misc_difference 50: note = a, t, c, g, unknown or other
  misc_difference 51: note = a, t, c, g, unknown or other
  misc_difference 52: note = a, t, c, g, unknown or other
  misc_difference 53: note = a, t, c, g, unknown or other
  misc_difference 54: note = a, t, c, g, unknown or other
  misc_difference 55: note = a, t, c, g, unknown or other
  misc_difference 56: note = a, t, c, g, unknown or other
  misc_difference 57: note = a, t, c, g, unknown or other
  misc_difference 58: note = a, t, c, g, unknown or other
  misc_difference 59: note = a, t, c, g, unknown or other
  misc_difference 60: note = a, t, c, g, unknown or other
  misc_difference 61: note = a, t, c, g, unknown or other
  misc_difference 62: note = a, t, c, g, unknown or other
  misc_difference 63: note = a, t, c, g, unknown or other
  misc_difference 64: note = a, t, c, g, unknown or other
  misc_difference 65: note = a, t, c, g, unknown or other
  misc_difference 66: note = a, t, c, g, unknown or other
  misc_difference 67: note = a, t, c, g, unknown or other
  misc_difference 68: note = a, t, c, g, unknown or other
  misc_difference 69: note = a, t, c, g, unknown or other
  misc_difference 70: note = a, t, c, g, unknown or other
  misc_difference 71: note = a, t, c, g, unknown or other
  misc_difference 72: note = a, t, c, g, unknown or other
  misc_difference 73: note = a, t, c, g, unknown or other
  misc_difference 74: note = a, t, c, g, unknown or other
  misc_difference 75: note = a, t, c, g, unknown or other
  misc_difference 76: note = a, t, c, g, unknown or other
  misc_difference 77: note = a, t, c, g, unknown or other
  misc_difference 78: note = a, t, c, g, unknown or other
  misc_difference 79: note = a, t, c, g, unknown or other
  misc_difference 80: note = a, t, c, g, unknown or other
  misc_difference 81: note = a, t, c, g, unknown or other
  misc_difference 82: note = a, t, c, g, unknown or other
  misc_difference 83: note = a, t, c, g, unknown or other
  misc_difference 84: note = a, t, c, g, unknown or other
  misc_difference 85: note = a, t, c, g, unknown or other
  misc_difference 86: note = a, t, c, g, unknown or other
  misc_difference 87: note = a, t, c, g, unknown or other
  misc_difference 88: note = a, t, c, g, unknown or other
  misc_difference 89: note = a, t, c, g, unknown or other
  misc_difference 90: note = a, t, c, g, unknown or other
  misc_difference 91: note = a, t, c, g, unknown or other
  misc_difference 92: note = a, t, c, g, unknown or other
  misc_difference 93: note = a, t, c, g, unknown or other
  misc_difference 94: note = a, t, c, g, unknown or other
  misc_difference 95: note = a, t, c, g, unknown or other
  misc_difference 96: note = a, t, c, g, unknown or other
  misc_difference 97: note = a, t, c, g, unknown or other
  misc_difference 98: note = a, t, c, g, unknown or other
  misc_difference 99: note = a, t, c, g, unknown or other
  misc_difference 100: note = a, t, c, g, unknown or other
  misc_difference 101: note = a, t, c, g, unknown or other
  misc_difference 102: note = a, t, c, g, unknown or other
  misc_difference 103: note = a, t, c, g, unknown or other
  misc_difference 104: note = a, t, c, g, unknown or other
  misc_difference 105: note = a, t, c, g, unknown or other
  misc_difference 106: note = a, t, c, g, unknown or other
  misc_difference 107: note = a, t, c, g, unknown or other
  misc_difference 108: note = a, t, c, g, unknown or other
  misc_difference 109: note = a, t, c, g, unknown or other
  misc_difference 110: note = a, t, c, g, unknown or other
  misc_difference 111: note = a, t, c, g, unknown or other
  misc_difference 112: note = a, t, c, g, unknown or other
  misc_difference 113: note = a, t, c, g, unknown or other
  misc_difference 114: note = a, t, c, g, unknown or other
  misc_difference 115: note = a, t, c, g, unknown or other
  misc_difference 116: note = a, t, c, g, unknown or other
  misc_difference 117: note = a, t, c, g, unknown or other
  misc_difference 118: note = a, t, c, g, unknown or other
  misc_difference 119: note = a, t, c, g, unknown or other
  misc_difference 120: note = a, t, c, g, unknown or other
  misc_difference 121: note = a, t, c, g, unknown or other
  misc_difference 122: note = a, t, c, g, unknown or other
  misc_difference 123: note = a, t, c, g, unknown or other
  misc_difference 124: note = a, t, c, g, unknown or other
  misc_difference 125: note = a, t, c, g, unknown or other
  misc_difference 126: note = a, t, c, g, unknown or other
  misc_difference 127: note = a, t, c, g, unknown or other
  misc_difference 128: note = a, t, c, g, unknown or other
  misc_difference 129: note = a, t, c, g, unknown or other
  misc_difference 130: note = a, t, c, g, unknown or other
  misc_difference 131: note = a, t, c, g, unknown or other
  misc_difference 132: note = a, t, c, g, unknown or other
  misc_difference 133: note = a, t, c, g, unknown or other
  misc_difference 134: note = a, t, c, g, unknown or other
  misc_difference 135: note = a, t, c, g, unknown or other
  misc_difference 136: note = a, t, c, g, unknown or other
  misc_difference 137: note = a, t, c, g, unknown or other
  misc_difference 138: note = a, t, c, g, unknown or other
  misc_difference 139: note = a, t, c, g, unknown or other
  misc_difference 140: note = a, t, c, g, unknown or other
  misc_difference 141: note = a, t, c, g, unknown or other
  misc_difference 142: note = a, t, c, g, unknown or other
  misc_difference 143: note = a, t, c, g, unknown or other
  misc_difference 144: note = a, t, c, g, unknown or other
  misc_difference 145: note = a, t, c, g, unknown or other
  misc_difference 146: note = a, t, c, g, unknown or other
  misc_difference 147: note = a, t, c, g, unknown or other
  misc_difference 148: note = a, t, c, g, unknown or other
  misc_difference 149: note = a, t, c, g, unknown or other
  misc_difference 150: note = a, t, c, g, unknown or other
  misc_difference 151: note = a, t, c, g, unknown or other
  misc_difference 152: note = a, t, c, g, unknown or other
  misc_difference 153: note = a, t, c, g, unknown or other
  misc_difference 154: note = a, t, c, g, unknown or other
  misc_difference 155: note = a, t, c, g, unknown or other
  misc_difference 156: note = a, t, c, g, unknown or other
  misc_difference 157: note = a, t, c, g, unknown or other
  misc_difference 158: note = a, t, c, g, unknown or other
  misc_difference 159: note = a, t, c, g, unknown or other
  misc_difference 160: note = a, t, c, g, unknown or other
  misc_difference 161: note = a, t, c, g, unknown or other
  misc_difference 162: note = a, t, c, g, unknown or other
  misc_difference 163: note = a, t, c, g, unknown or other
  misc_difference 164: note = a, t, c, g, unknown or other
  misc_difference 165: note = a, t, c, g, unknown or other
  misc_difference 166: note = a, t, c, g, unknown or other
  misc_difference 167: note = a, t, c, g, unknown or other
  misc_difference 168: note = a, t, c, g, unknown or other
  misc_difference 169: note = a, t, c, g, unknown or other
  misc_difference 170: note = a, t, c, g, unknown or other
  misc_difference 171: note = a, t, c, g, unknown or other
  misc_difference 172: note = a, t, c, g, unknown or other
  misc_difference 173: note = a, t, c, g, unknown or other
  misc_difference 174: note = a, t, c, g, unknown or other
  misc_difference 175: note = a, t, c, g, unknown or other
  misc_difference 176: note = a, t, c, g, unknown or other
  misc_difference 177: note = a, t, c, g, unknown or other
  misc_difference 178: note = a, t, c, g, unknown or other
  misc_difference 179: note = a, t, c, g, unknown or other
  misc_difference 180: note = a, t, c, g, unknown or other
  misc_difference 181: note = a, t, c, g, unknown or other
  misc_difference 182: note = a, t, c, g, unknown or other
  misc_difference 183: note = a, t, c, g, unknown or other
  misc_difference 184: note = a, t, c, g, unknown or other
  misc_difference 185: note = a, t, c, g, unknown or other
  misc_difference 186: note = a, t, c, g, unknown or other
  misc_difference 187: note = a, t, c, g, unknown or other
  misc_difference 188: note = a, t, c, g, unknown or other
  misc_difference 189: note = a, t, c, g, unknown or other
  misc_difference 190: note = a, t, c, g, unknown or other
  misc_difference 191: note = a, t, c, g, unknown or other
  misc_difference 192: note = a, t, c, g, unknown or other
  misc_difference 193: note = a, t, c, g, unknown or other
  misc_difference 194: note = a, t, c, g, unknown or other
  misc_difference 195: note = a, t, c, g, unknown or other
  misc_difference 196: note = a, t, c, g, unknown or other
  misc_difference 197: note = a, t, c, g, unknown or other
  misc_difference 198: note = a, t, c, g, unknown or other
  misc_difference 199: note = a, t, c, g, unknown or other
  misc_difference 200: note = a, t, c, g, unknown or other
  misc_difference 201: note = a, t, c, g, unknown or other
  misc_difference 202: note = a, t, c, g, unknown or other
  misc_difference 203: note = a, t, c, g, unknown or other
  misc_difference 204: note = a, t, c, g, unknown or other
  misc_difference 205: note = a, t, c, g, unknown or other
  misc_difference 206: note = a, t, c, g, unknown or other
  misc_difference 207: note = a, t, c, g, unknown or other
  misc_difference 208: note = a, t, c, g, unknown or other
  misc_difference 209: note = a, t, c, g, unknown or other
  misc_difference 210: note = a, t, c, g, unknown or other
  misc_difference 211: note = a, t, c, g, unknown or other
  misc_difference 212: note = a, t, c, g, unknown or other
  misc_difference 213: note = a, t, c, g, unknown or other
  misc_difference 214: note = a, t, c, g, unknown or other
  misc_difference 215: note = a, t, c, g, unknown or other
  misc_difference 216: note = a, t, c, g, unknown or other
  misc_difference 217: note = a, t, c, g, unknown or other
  misc_difference 218: note = a, t, c, g, unknown or other
  misc_difference 219: note = a, t, c, g, unknown or other
  misc_difference 220: note = a, t, c, g, unknown or other
  misc_difference 221: note = a, t, c, g, unknown or other
  misc_difference 222: note = a, t, c, g, unknown or other
  misc_difference 223: note = a, t, c, g, unknown or other
  misc_difference 224: note = a, t, c, g, unknown or other
  misc_difference 225: note = a, t, c, g, unknown or other
  misc_difference 226: note = a, t, c, g, unknown or other
  misc_difference 227: note = a, t, c, g, unknown or other
  misc_difference 228: note = a, t, c, g, unknown or other
  misc_difference 229: note = a, t, c, g, unknown or other
  misc_difference 230: note = a, t, c, g, unknown or other
  misc_difference 231: note = a, t, c, g, unknown or other
  misc_difference 232: note = a, t, c, g, unknown or other
  misc_difference 233: note = a, t, c, g, unknown or other
  misc_difference 234: note = a, t, c, g, unknown or other
  misc_difference 235: note = a, t, c, g, unknown or other
  misc_difference 236: note = a, t, c, g, unknown or other
  misc_difference 237: note = a, t, c, g, unknown or other
  misc_difference 238: note = a, t, c, g, unknown or other
  misc_difference 239: note = a, t, c, g, unknown or other
  misc_difference 240: note = a, t, c, g, unknown or other
  misc_difference 241: note = a, t, c, g, unknown or other
  misc_difference 242: note = a, t, c, g, unknown or other
  misc_difference 243: note = a, t, c, g, unknown or other
  misc_difference 244: note = a, t, c, g, unknown or other
  misc_difference 245: note = a, t, c, g, unknown or other
  misc_difference 246: note = a, t, c, g, unknown or other
  misc_difference 247: note = a, t, c, g, unknown or other
  misc_difference 248: note = a, t, c, g, unknown or other
  misc_difference 249: note = a, t, c, g, unknown or other
  misc_difference 250: note = a, t, c, g, unknown or other
  misc_difference 251: note = a, t, c, g, unknown or other
  misc_difference 252: note = a, t, c, g, unknown or other
  misc_difference 253: note = a, t, c, g, unknown or other
  misc_difference 254: note = a, t, c, g, unknown or other
  misc_difference 255: note = a, t, c, g, unknown or other
  misc_difference 256: note = a, t, c, g, unknown or other
  misc_difference 257: note = a, t, c, g, unknown or other
  misc_difference 258: note = a, t, c, g, unknown or other
  misc_difference 259: note = a, t, c, g, unknown or other
  misc_difference 260: note = a, t, c, g, unknown or other
  misc_difference 261: note = a, t, c, g, unknown or other
  misc_difference 262: note = a, t, c, g, unknown or other
  misc_difference 263: note = a, t, c, g, unknown or other
  misc_difference 264: note = a, t, c, g, unknown or other
  misc_difference 265: note = a, t, c, g, unknown or other
  misc_difference 266: note = a, t, c, g, unknown or other
  misc_difference 267: note = a, t, c, g, unknown or other
  misc_difference 268: note = a, t, c, g, unknown or other
  misc_difference 269: note = a, t, c, g, unknown or other
  misc_difference 270: note = a, t, c, g, unknown or other
  misc_difference 271: note = a, t, c, g, unknown or other
  misc_difference 272: note = a, t, c, g, unknown or other
  misc_difference 273: note = a, t, c, g, unknown or other
  misc_difference 274: note = a, t, c, g, unknown or other
  misc_difference 275: note = a, t, c, g, unknown or other
  misc_difference 276: note = a, t, c, g, unknown or other
  misc_difference 277: note = a, t, c, g, unknown or other
  misc_difference 278: note = a, t, c, g, unknown or other
  misc_difference 279: note = a, t, c, g, unknown or other
  misc_difference 280: note = a, t, c, g, unknown or other
  misc_difference 281: note = a, t, c, g, unknown or other
  misc_difference 282: note = a, t, c, g, unknown or other
  misc_difference 283: note = a, t, c, g, unknown or other
  misc_difference 284: note = a, t, c, g, unknown or other
  misc_difference 285: note = a, t, c, g, unknown or other
  misc_difference 286: note = a, t, c, g, unknown or other
  misc_difference 287: note = a, t, c, g, unknown or other
  misc_difference 288: note = a, t, c, g, unknown or other
  misc_difference 289: note = a, t, c, g, unknown or other
  misc_difference 290: note = a, t, c, g, unknown or other
  misc_difference 291: note = a, t, c, g, unknown or other
  misc_difference 292: note = a, t, c, g, unknown or other
  misc_difference 293: note = a, t, c, g, unknown or other
  misc_difference 294: note = a, t, c, g, unknown or other
  misc_difference 295: note = a, t, c, g, unknown or other
  misc_difference 296: note = a, t, c, g, unknown or other
  misc_difference 297: note = a, t, c, g, unknown or other
  misc_difference 298: note = a, t, c, g, unknown or other
  misc_difference 299: note = a, t, c, g, unknown or other
  misc_difference 300: note = a, t, c, g, unknown or other
  misc_difference 301: note = a, t, c, g, unknown or other
  misc_difference 302: note = a, t, c, g, unknown or other
  misc_difference 303: note = a, t, c, g, unknown or other
  misc_difference 304: note = a, t, c, g, unknown or other
  misc_difference 305: note = a, t, c, g, unknown or other
  misc_difference 306: note = a, t, c, g, unknown or other
  misc_difference 307: note = a, t, c, g, unknown or other
  misc_difference 308: note = a, t, c, g, unknown or other
  misc_difference 309: note = a, t, c, g, unknown or other
  misc_difference 310: note = a, t, c, g, unknown or other
  misc_difference 311: note = a, t, c, g, unknown or other
  misc_difference 312: note = a, t, c, g, unknown or other
  misc_difference 313: note = a, t, c, g, unknown or other
  misc_difference 314: note = a, t, c, g, unknown or other
  misc_difference 315: note = a, t, c, g, unknown or other
  misc_difference 316: note = a, t, c, g, unknown or other
  misc_difference 317: note = a, t, c, g, unknown or other
  misc_difference 318: note = a, t, c, g, unknown or other
  misc_difference 319: note = a, t, c, g, unknown or other
  misc_difference 320: note = a, t, c, g, unknown or other
  misc_difference 321: note = a, t, c, g, unknown or other
  misc_difference 322: note = a, t, c, g, unknown or other
  misc_difference 323: note = a, t, c, g, unknown or other
  misc_difference 324: note = a, t, c, g, unknown or other
  misc_difference 325: note = a, t, c, g, unknown or other
  misc_difference 326: note = a, t, c, g, unknown or other
  misc_difference 327: note = a, t, c, g, unknown or other
  misc_difference 328: note = a, t, c, g, unknown or other
  misc_difference 329: note = a, t, c, g, unknown or other
  misc_difference 330: note = a, t, c, g, unknown or other
  misc_difference 331: note = a, t, c, g, unknown or other
  misc_difference 332: note = a, t, c, g, unknown or other
  misc_difference 333: note = a, t, c, g, unknown or other
  misc_difference 334: note = a, t, c, g, unknown or other
  misc_difference 335: note = a, t, c, g, unknown or other
  misc_difference 336: note = a, t, c, g, unknown or other
  misc_difference 337: note = a, t, c, g, unknown or other
  misc_difference 338: note = a, t, c, g, unknown or other
  misc_difference 339: note = a, t, c, g, unknown or other
  misc_difference 340: note = a, t, c, g, unknown or other
  misc_difference 341: note = a, t, c, g, unknown or other
  misc_difference 342: note = a, t, c, g, unknown or other
  misc_difference 343: note = a, t, c, g, unknown or other
  misc_difference 344: note = a, t, c, g, unknown or other
  misc_difference 345: note = a, t, c, g, unknown or other
  misc_difference 346: note = a, t, c, g, unknown or other
  misc_difference 347: note = a, t, c, g, unknown or other
  misc_difference 348: note = a, t, c, g, unknown or other
  misc_difference 349: note = a, t, c, g, unknown or other
  misc_difference 350: note = a, t, c, g, unknown or other
  misc_difference 351: note = a, t, c, g, unknown or other
  misc_difference 352: note = a, t, c, g, unknown or other
  misc_difference 353: note = a, t, c, g, unknown or other
  misc_difference 354: note = a, t, c, g, unknown or other
  misc_difference 355: note = a, t, c, g, unknown or other
  misc_difference 356: note = a, t, c, g, unknown or other
  misc_difference 357: note = a, t, c, g, unknown or other
  misc_difference 358: note = a, t, c, g, unknown or other
  misc_difference 359: note = a, t, c, g, unknown or other
  misc_difference 360: note = a, t, c, g, unknown or other
  misc_difference 361: note = a, t, c, g, unknown or other
  misc_difference 362: note = a, t, c, g, unknown or other
  misc_difference 363: note = a, t, c, g, unknown or other
  misc_difference 364: note = a, t, c, g, unknown or other
  misc_difference 365: note = a, t, c, g, unknown or other
  misc_difference 366: note = a, t, c, g, unknown or other
  misc_difference 367: note = a, t, c, g, unknown or other
  misc_difference 368: note = a, t, c, g, unknown or other
  misc_difference 369: note = a, t, c, g, unknown or other
  misc_difference 370: note = a, t, c, g, unknown or other
  misc_difference 371: note = a, t, c, g, unknown or other
  misc_difference 372: note = a, t, c, g, unknown or other
  misc_difference 373: note = a, t, c, g, unknown or other
  misc_difference 374: note = a, t, c, g, unknown or other
  misc_difference 375: note = a, t, c, g, unknown or other
  misc_difference 376: note = a, t, c, g, unknown or other
  misc_difference 377: note = a, t, c, g, unknown or other
  misc_difference 378: note = a, t, c, g, unknown or other
  misc_difference 379: note = a, t, c, g, unknown or other
  misc_difference 380: note = a, t, c, g, unknown or other
  misc_difference 381: note = a, t, c, g, unknown or other
  misc_difference 382: note = a, t, c, g, unknown or other
  misc_difference 383: note = a, t, c, g, unknown or other
  misc_difference 384: note = a, t, c, g, unknown or other
  misc_difference 385: note = a, t, c, g, unknown or other
  misc_difference 386: note = a, t, c, g, unknown or other
  misc_difference 387: note = a, t, c, g, unknown or other
  misc_difference 388: note = a, t, c, g, unknown or other
  misc_difference 389: note = a, t, c, g, unknown or other
  misc_difference 390: note = a, t, c, g, unknown or other
  misc_difference 391: note = a, t, c, g, unknown or other
  misc_difference 392: note = a, t, c, g, unknown or other
  misc_difference 393: note = a, t, c, g, unknown or other
  misc_difference 394: note = a, t, c, g, unknown or other
  misc_difference 395: note = a, t, c, g, unknown or other
  misc_difference 396: note = a, t, c, g, unknown or other
  misc_difference 397: note = a, t, c, g, unknown or other
  misc_difference 398: note = a, t, c, g, unknown or other
  misc_difference 399: note = a, t, c, g, unknown or other
  misc_difference 400: note = a, t, c, g, unknown or other
  misc_difference 401: note = a, t, c, g, unknown or other
  misc_difference 402: note = a, t, c, g, unknown or other
  misc_difference 403: note = a, t, c, g, unknown or other
  misc_difference 404: note = a, t, c, g, unknown or other
  misc_difference 405: note = a, t, c, g, unknown or other
  misc_difference 406: note = a, t, c, g, unknown or other
  misc_difference 407: note = a, t, c, g, unknown or other
  misc_difference 408: note = a, t, c, g, unknown or other
  misc_difference 409: note = a, t, c, g, unknown or other
  misc_difference 410: note = a, t, c, g, unknown or other
  misc_difference 411: note = a, t, c, g, unknown or other
  misc_difference 412: note = a, t, c, g, unknown or other
  misc_difference 413: note = a, t, c, g, unknown or other
  misc_difference 414: note = a, t, c, g, unknown or other
  misc_difference 415: note = a, t, c, g, unknown or other
  misc_difference 416: note = a, t, c, g, unknown or other
  misc_difference 417: note = a, t, c, g, unknown or other
  misc_difference 418: note = a, t, c, g, unknown or other
  misc_difference 419: note = a, t, c, g, unknown or other
  misc_difference 420: note = a, t, c, g, unknown or other
  misc_difference 421: note = a, t, c, g, unknown or other
  misc_difference 422: note = a, t, c, g, unknown or other
  misc_difference 423: note = a, t, c, g, unknown or other
  misc_difference 424: note = a, t, c, g, unknown or other
  misc_difference 425: note = a, t, c, g, unknown or other
  misc_difference 426: note = a, t, c, g, unknown or other
  misc_difference 427: note = a, t, c, g, unknown or other
  misc_difference 428: note = a, t, c, g, unknown or other
  misc_difference 429: note = a, t, c, g, unknown or other
  misc_difference 430: note = a, t, c, g, unknown or other
  misc_difference 431: note = a, t, c, g, unknown or other
  misc_difference 432: note = a, t, c, g, unknown or other
  misc_difference 433: note = a, t, c, g, unknown or other
  misc_difference 434: note = a, t, c, g, unknown or other
  misc_difference 435: note = a, t, c, g, unknown or other
  misc_difference 436: note = a, t, c, g, unknown or other
  misc_difference 437: note = a, t, c, g, unknown or other
  misc_difference 438: note = a, t, c, g, unknown or other
  misc_difference 439: note = a, t, c, g, unknown or other
  misc_difference 440: note = a, t, c, g, unknown or other
  misc_difference 441: note = a, t, c, g, unknown or other
  misc_difference 442: note = a, t, c, g, unknown or other
  misc_difference 443: note = a, t, c, g, unknown or other
  misc_difference 444: note = a, t, c, g, unknown or other
  misc_difference 445: note = a, t, c, g, unknown or other
  misc_difference 446: note = a, t, c, g, unknown or other
  misc_difference 447: note = a, t, c, g, unknown or other
  misc_difference 448: note = a, t, c, g, unknown or other
  misc_difference 449: note = a, t, c, g, unknown or other
  misc_difference 450: note = a, t, c, g, unknown or other
  misc_difference 451: note = a, t, c, g, unknown or other
  misc_difference 452: note = a, t, c, g, unknown or other
  misc_difference 453: note = a, t, c, g, unknown or other
  misc_difference 454: note = a, t, c, g, unknown or other
  misc_difference 455: note = a, t, c, g, unknown or other
  misc_difference 456: note = a, t, c, g, unknown or other
  misc_difference 457: note = a, t, c, g, unknown or other
  misc_difference 458: note = a, t, c, g, unknown or other
  misc_difference 459: note = a, t, c, g, unknown or other
  misc_difference 460: note = a, t, c, g, unknown or other
  misc_difference 461: note = a, t, c, g, unknown or other
  misc_difference 462: note = a, t, c, g, unknown or other
  misc_difference 463: note = a, t, c, g, unknown or other
  misc_difference 464: note = a, t, c, g, unknown or other
  misc_difference 465: note = a, t, c, g, unknown or other
  misc_difference 466: note = a, t, c, g, unknown or other
  misc_difference 467: note = a, t, c, g, unknown or other
  misc_difference 468: note = a, t, c, g, unknown or other
  misc_difference 469: note = a, t, c, g, unknown or other
  misc_difference 470: note = a, t, c, g, unknown or other
  misc_difference 471: note = a, t, c, g, unknown or other
  misc_difference 472: note = a, t, c, g, unknown or other
  misc_difference 473: note = a, t, c, g, unknown or other
  misc_difference 474: note = a, t, c, g, unknown or other
  misc_difference 475: note = a, t, c, g, unknown or other
  misc_difference 476: note = a, t, c, g, unknown or other
  misc_difference 477: note = a, t, c, g, unknown or other
  misc_difference 478: note = a, t, c, g, unknown or other
  misc_difference 479: note = a, t, c, g, unknown or other
  misc_difference 480: note = a, t, c, g, unknown or other
  misc_difference 481: note = a, t, c, g, unknown or other
  misc_difference 482: note = a, t, c, g, unknown or other
  misc_difference 483: note = a, t, c, g, unknown or other
  misc_difference 484: note = a, t, c, g, unknown or other
  misc_difference 485: note = a, t, c, g, unknown or other
  misc_difference 486: note = a, t, c, g, unknown or other
  misc_difference 487: note = a, t, c, g, unknown or other
  misc_difference 488: note = a, t, c, g, unknown or other
  misc_difference 489: note = a, t, c, g, unknown or other
  misc_difference 490: note = a, t, c, g, unknown or other
  misc_difference 491: note = a, t, c, g, unknown or other
  misc_difference 492: note = a, t, c, g, unknown or other
  misc_difference 493: note = a, t, c, g, unknown or other
  misc_difference 494: note = a, t, c, g, unknown or other
  misc_difference 495: note = a, t, c, g, unknown or other
  misc_difference 496: note = a, t, c, g, unknown or other
  misc_difference 497: note = a, t, c, g, unknown or other
  misc_difference 498: note = a, t, c, g, unknown or other
  misc_difference 499: note = a, t, c, g, unknown or other
  misc_difference 500: note = a, t, c, g, unknown or other
  misc_difference 501: note = a, t, c, g, unknown or other
  misc_difference 502: note = a, t, c, g, unknown or other
  misc_difference 503: note = a, t, c, g, unknown or other
  misc_difference 504: note = a, t, c, g, unknown or other
  misc_difference 505: note = a, t, c, g, unknown or other
  misc_difference 506: note = a, t, c, g, unknown or other
  misc_difference 507: note = a, t, c, g, unknown or other
  misc_difference 508: note = a, t, c, g, unknown or other
  misc_difference 509: note = a, t, c, g, unknown or other
  misc_difference 510: note = a, t, c, g, unknown or other
  misc_difference 511: note = a, t, c, g, unknown or other
  misc_difference 512: note = a, t, c, g, unknown or other
  misc_difference 513: note = a, t, c, g, unknown or other
  misc_difference 514: note = a, t, c, g, unknown or other
  misc_difference 515: note = a, t, c, g, unknown or other
  misc_difference 516: note = a, t, c, g, unknown or other
  misc_difference 517: note = a, t, c, g, unknown or other
  misc_difference 518: note = a, t, c, g, unknown or other
  misc_difference 519: note = a, t, c, g, unknown or other
  misc_difference 520: note = a, t, c, g, unknown or other
  misc_difference 521: note = a, t, c, g, unknown or other
  misc_difference 522: note = a, t, c, g, unknown or other
  misc_difference 523: note = a, t, c, g, unknown or other
  misc_difference 524: note = a, t, c, g, unknown or other
  misc_difference 525: note = a, t, c, g, unknown or other
  misc_difference 526: note = a, t, c, g, unknown or other
  misc_difference 527: note = a, t, c, g, unknown or other
  misc_difference 528: note = a, t, c, g, unknown or other
  misc_difference 529: note = a, t, c, g, unknown or other
  misc_difference 530: note = a, t, c, g, unknown or other
  misc_difference 531: note = a, t, c, g, unknown or other
  misc_difference 532: note = a, t, c, g, unknown or other
  misc_difference 533: note = a, t, c, g, unknown or other
  misc_difference 534: note = a, t, c, g, unknown or other
  misc_difference 535: note = a, t, c, g, unknown or other
  misc_difference 536: note = a, t, c, g, unknown or other
  misc_difference 537: note = a, t, c, g, unknown or other
  misc_difference 538: note = a, t, c, g, unknown or other
  misc_difference 539: note = a, t, c, g, unknown or other
  misc_difference 540: note = a, t, c, g, unknown or other
  misc_difference 541: note = a, t, c, g, unknown or other
  misc_difference 542: note = a, t, c, g, unknown or other
  misc_difference 543: note = a, t, c, g, unknown or other
  misc_difference 544: note = a, t, c, g, unknown or other
  misc_difference 545: note = a, t, c, g, unknown or other
  misc_difference 546: note = a, t, c, g, unknown or other
  misc_difference 547: note = a, t, c, g, unknown or other
  misc_difference 548: note = a, t, c, g, unknown or other
  misc_difference 549: note = a, t, c, g, unknown or other
  misc_difference 550: note = a, t, c, g, unknown or other
  misc_difference 551: note = a, t, c, g, unknown or other
  misc_difference 552: note = a, t, c, g, unknown or other
  misc_difference 553: note = a, t, c, g, unknown or other
  misc_difference 554: note = a, t, c, g, unknown or other
  misc_difference 555: note = a, t, c, g, unknown or other
  misc_difference 556: note = a, t, c, g, unknown or other
  misc_difference 557: note = a, t, c, g, unknown or other
  misc_difference 558: note = a, t, c, g, unknown or other
  misc_difference 559: note = a, t, c, g, unknown or other
  misc_difference 560: note = a, t, c, g, unknown or other
  misc_difference 561: note = a, t, c, g, unknown or other
  misc_difference 562: note = a, t, c, g, unknown or other
  misc_difference 563: note = a, t, c, g, unknown or other
  misc_difference 564: note = a, t, c, g, unknown or other
  misc_difference 565: note = a, t, c, g, unknown or other
  misc_difference 566: note = a, t, c, g, unknown or other
  misc_difference 567: note = a, t, c, g, unknown or other
  misc_difference 568: note = a, t, c, g, unknown or other
  misc_difference 569: note = a, t, c, g, unknown or other
  misc_difference 570: note = a, t, c, g, unknown or other
  misc_difference 571: note = a, t, c, g, unknown or other
  misc_difference 572: note = a, t, c, g, unknown or other
  misc_difference 573: note = a, t, c, g, unknown or other
  misc_difference 574: note = a, t, c, g, unknown or other
  misc_difference 575: note = a, t, c, g, unknown or other
  misc_difference 576: note = a, t, c, g, unknown or other
  misc_difference 577: note = a, t, c, g, unknown or other
  misc_difference 578: note = a, t, c, g, unknown or other
  misc_difference 579: note = a, t, c, g, unknown or other
  misc_difference 580: note = a, t, c, g, unknown or other
  misc_difference 581: note = a, t, c, g, unknown or other
  misc_difference 582: note = a, t, c, g, unknown or other
  misc_difference 583: note = a, t, c, g, unknown or other
  misc_difference 584: note = a, t, c, g, unknown or other
  misc_difference 585: note = a, t, c, g, unknown or other
  misc_difference 586: note = a, t, c, g, unknown or other
  misc_difference 587: note = a, t, c, g, unknown or other
  misc_difference 588: note = a, t, c, g, unknown or other
  misc_difference 589: note = a, t, c, g, unknown or other
  misc_difference 590: note = a, t, c, g, unknown or other
  misc_difference 591: note = a, t, c, g, unknown or other
  misc_difference 592: note = a, t, c, g, unknown or other
  misc_difference 593: note = a, t, c, g, unknown or other
  misc_difference 594: note = a, t, c, g, unknown or other
  misc_difference 595: note = a, t, c, g, unknown or other
  misc_difference 596: note = a, t, c, g, unknown or other
  misc_difference 597: note = a, t, c, g, unknown or other
  misc_difference 598: note = a, t, c, g, unknown or other
  misc_difference 599: note = a, t, c, g, unknown or other
  misc_difference 600: note = a, t, c, g, unknown or other
  misc_difference 601: note = a, t, c, g, unknown or other
  misc_difference 602: note = a, t, c, g, unknown or other
  misc_difference 603: note = a, t, c, g, unknown or other
  misc_difference 604: note = a, t, c, g, unknown or other
  misc_difference 605: note = a, t, c, g, unknown or other
  misc_difference 606: note = a, t, c, g, unknown or other
  misc_difference 607: note = a, t, c, g, unknown or other
  misc_difference 608: note = a, t, c, g, unknown or other
  misc_difference 609: note = a, t, c, g, unknown or other
  misc_difference 610: note = a, t, c, g, unknown or other
  misc_difference 611: note = a, t, c, g, unknown or other
  misc_difference 612: note = a, t, c, g, unknown or other
  misc_difference 613: note = a, t, c, g, unknown or other
  misc_difference 614: note = a, t, c, g, unknown or other
  misc_difference 615: note = a, t, c, g, unknown or other
  misc_difference 616: note = a, t, c, g, unknown or other
  misc_difference 617: note = a, t, c, g, unknown or other
  misc_difference 618: note = a, t, c, g, unknown or other
  misc_difference 619: note = a, t, c, g, unknown or other
  misc_difference 620: note = a, t, c, g, unknown or other
  misc_difference 621: note = a, t, c, g, unknown or other
  misc_difference 622: note = a, t, c, g, unknown or other
  misc_difference 623: note = a, t, c, g, unknown or other
  misc_difference 624: note = a, t, c, g, unknown or other
  misc_difference 625: note = a, t, c, g, unknown or other
  misc_difference 626: note = a, t, c, g, unknown or other
  misc_difference 627: note = a, t, c, g, unknown or other
  misc_difference 628: note = a, t, c, g, unknown or other
  misc_difference 629: note = a, t, c, g, unknown or other
  misc_difference 630: note = a, t, c, g, unknown or other
  misc_difference 631: note = a, t, c, g, unknown or other
  misc_difference 632: note = a, t, c, g, unknown or other
  misc_difference 633: note = a, t, c, g, unknown or other
  misc_difference 634: note = a, t, c, g, unknown or other
  misc_difference 635: note = a, t, c, g, unknown or other
  misc_difference 636: note = a, t, c, g, unknown or other
  misc_difference 637: note = a, t, c, g, unknown or other
  misc_difference 638: note = a, t, c, g, unknown or other
  misc_difference 639: note = a, t, c, g, unknown or other
  misc_difference 640: note = a, t, c, g, unknown or other
  misc_difference 641: note = a, t, c, g, unknown or other
  misc_difference 642: note = a, t, c, g, unknown or other
  misc_difference 643: note = a, t, c, g, unknown or other
  misc_difference 644: note = a, t, c, g, unknown or other
  misc_difference 645: note = a, t, c, g, unknown or other
  misc_difference 646: note = a, t, c, g, unknown or other
  misc_difference 647: note = a, t, c, g, unknown or other
  misc_difference 648: note = a, t, c, g, unknown or other
  misc_difference 649: note = a, t, c, g, unknown or other
  misc_difference 650: note = a, t, c, g, unknown or other
  misc_difference 651: note = a, t, c, g, unknown or other
  misc_difference 652: note = a, t, c, g, unknown or other
  misc_difference 653: note = a, t, c, g, unknown or other
  misc_difference 654: note = a, t, c, g, unknown or other
  misc_difference 655: note = a, t, c, g, unknown or other
  misc_difference 656: note = a, t, c, g, unknown or other
  misc_difference 657: note = a, t, c, g, unknown or other
  misc_difference 658: note = a, t, c, g, unknown or other
  misc_difference 659: note = a, t, c, g, unknown or other
  misc_difference 660: note = a, t, c, g, unknown or other
  misc_difference 661: note = a, t, c, g, unknown or other
  misc_difference 662: note = a, t, c, g, unknown or other
  misc_difference 663: note = a, t, c, g, unknown or other
  misc_difference 664: note = a, t, c, g, unknown or other
  misc_difference 665: note = a, t, c, g, unknown or other
  misc_difference 666: note = a, t, c, g, unknown or other
  misc_difference 667: note = a, t, c, g, unknown or other
  misc_difference 668: note = a, t, c, g, unknown or other
  misc_difference 669: note = a, t, c, g, unknown or other
  misc_difference 670: note = a, t, c, g, unknown or other
  misc_difference 671: note = a, t, c, g, unknown or other
  misc_difference 672: note = a, t, c, g, unknown or other
  misc_difference 673: note = a, t, c, g, unknown or other
  misc_difference 674: note = a, t, c, g, unknown or other
  misc_difference 675: note = a, t, c, g, unknown or other
  misc_difference 676: note = a, t, c, g, unknown or other
  misc_difference 677: note = a, t, c, g, unknown or other
  misc_difference 678: note = a, t, c, g, unknown or other
  misc_difference 679: note = a, t, c, g, unknown or other
  misc_difference 680: note = a, t, c, g, unknown or other
  misc_difference 681: note = a, t, c, g, unknown or other
  misc_difference 682: note = a, t, c, g, unknown or other
  misc_difference 683: note = a, t, c, g, unknown or other
  misc_difference 684: note = a, t, c, g, unknown or other
  misc_difference 685: note = a, t, c, g, unknown or other
  misc_difference 686: note = a, t, c, g, unknown or other
  misc_difference 687: note = a, t, c, g, unknown or other
  misc_difference 688: note = a, t, c, g, unknown or other
  misc_difference 689: note = a, t, c, g, unknown or other
  misc_difference 690: note = a, t, c, g, unknown or other
  misc_difference 691: note = a, t, c, g, unknown or other
  misc_difference 692: note = a, t, c, g, unknown or other
  misc_difference 693: note = a, t, c, g, unknown or other
  misc_difference 694: note = a, t, c, g, unknown or other
  misc_difference 695: note = a, t, c, g, unknown or other
  misc_difference 696: note = a, t, c, g, unknown or other
  misc_difference 697: note = a, t, c, g, unknown or other
  misc_difference 698: note = a, t, c, g, unknown or other
  misc_difference 699: note = a, t, c, g, unknown or other
  misc_difference 700: note = a, t, c, g, unknown or other
  misc_difference 701: note = a, t, c, g, unknown or other
  misc_difference 702: note = a, t, c, g, unknown or other
  misc_difference 703: note = a, t, c, g, unknown or other
  misc_difference 704: note = a, t, c, g, unknown or other
  misc_difference 705: note = a, t, c, g, unknown or other
  misc_difference 706: note = a, t, c, g, unknown or other
  misc_difference 707: note = a, t, c, g, unknown or other
  misc_difference 708: note = a, t, c, g, unknown or other
  misc_difference 709: note = a, t, c, g, unknown or other
  misc_difference 710: note = a, t, c, g, unknown or other
  misc_difference 711: note = a, t, c, g, unknown or other
  misc_difference 712: note = a, t, c, g, unknown or other
  misc_difference 713: note = a, t, c, g, unknown or other
  misc_difference 714: note = a, t, c, g, unknown or other
  misc_difference 715: note = a, t, c, g, unknown or other
  misc_difference 716: note = a, t, c, g, unknown or other
  misc_difference 717: note = a, t, c, g, unknown or other
  misc_difference 718: note = a, t, c, g, unknown or other
  misc_difference 719: note = a, t, c, g, unknown or other
  misc_difference 720: note = a, t, c, g, unknown or other
  misc_difference 721: note = a, t, c, g, unknown or other
  misc_difference 722: note = a, t, c, g, unknown or other
  misc_difference 723: note = a, t, c, g, unknown or other
  misc_difference 724: note = a, t, c, g, unknown or other
  misc_difference 725: note = a, t, c, g, unknown or other
  misc_difference 726: note = a, t, c, g, unknown or other
  misc_difference 727: note = a, t, c, g, unknown or other
  misc_difference 728: note = a, t, c, g, unknown or other
  misc_difference 729: note = a, t, c, g, unknown or other
  misc_difference 730: note = a, t, c, g, unknown or other
  misc_difference 731: note = a, t, c, g, unknown or other
  misc_difference 732: note = a, t, c, g, unknown or other
  misc_difference 733: note = a, t, c, g, unknown or other
  misc_difference 734: note = a, t, c, g, unknown or other
  misc_difference 735: note = a, t, c, g, unknown or other
  misc_difference 736: note = a, t, c, g, unknown or other
  misc_difference 737: note = a, t, c, g, unknown or other
  misc_difference 738: note = a, t, c, g, unknown or other
  misc_difference 739: note = a, t, c, g, unknown or other
  misc_difference 740: note = a, t, c, g, unknown or other
  misc_difference 741: note = a, t, c, g, unknown or other
  misc_difference 742: note = a, t, c, g, unknown or other
  misc_difference 743: note = a, t, c, g, unknown or other
  misc_difference 744: note = a, t, c, g, unknown or other
  misc_difference 745: note = a, t, c, g, unknown or other
  misc_difference 746: note = a, t, c, g, unknown or other
  misc_difference 747: note = a, t, c, g, unknown or other
  misc_difference 748: note = a, t, c, g, unknown or other
  misc_difference 749: note = a, t, c, g, unknown or other
  misc_difference 750: note = a, t, c, g, unknown or other
  misc_difference 751: note = a, t, c, g, unknown or other
  misc_difference 752: note = a, t, c, g, unknown or other
  misc_difference 753: note = a, t, c, g, unknown or other
  misc_difference 754: note = a, t, c, g, unknown or other
  misc_difference 755: note = a, t, c, g, unknown or other
  misc_difference 756: note = a, t, c, g, unknown or other
  misc_difference 757: note = a, t, c, g, unknown or other
  misc_difference 758: note = a, t, c, g, unknown or other
  misc_difference 759: note = a, t, c, g, unknown or other
  misc_difference 760: note = a, t, c, g, unknown or other
  misc_difference 761: note = a, t, c, g, unknown or other
  misc_difference 762: note = a, t, c, g, unknown or other
  misc_difference 763: note = a, t, c, g, unknown or other
  misc_difference 764: note = a, t, c, g, unknown or other
  misc_difference 765: note = a, t, c, g, unknown or other
  misc_difference 766: note = a, t, c, g, unknown or other
  misc_difference 767: note = a, t, c, g, unknown or other
  misc_difference 768: note = a, t, c, g, unknown or other
  misc_difference 769: note = a, t, c, g, unknown or other
  misc_difference 770: note = a, t, c, g, unknown or other
  misc_difference 771: note = a, t, c, g, unknown or other
  misc_difference 772: note = a, t, c, g, unknown or other
  misc_difference 773: note = a, t, c, g, unknown or other
  misc_difference 774: note = a, t, c, g, unknown or other
  misc_difference 775: note = a, t, c, g, unknown or other
  misc_difference 776: note = a, t, c, g, unknown or other
  misc_difference 777: note = a, t, c, g, unknown or other
  misc_difference 778: note = a, t, c, g, unknown or other
  misc_difference 779: note = a, t, c, g, unknown or other
  misc_difference 780: note = a, t, c, g, unknown or other
  misc_difference 781: note = a, t, c, g, unknown or other
  misc_difference 782: note = a, t, c, g, unknown or other
  misc_difference 783: note = a, t, c, g, unknown or other
  misc_difference 784: note = a, t, c, g, unknown or other
  misc_difference 785: note = a, t, c, g, unknown or other
  misc_difference 786: note = a, t, c, g, unknown or other
  misc_difference 787: note = a, t, c, g, unknown or other
  misc_difference 788: note = a, t, c, g, unknown or other
  misc_difference 789: note = a, t, c, g, unknown or other
  misc_difference 790: note = a, t, c, g, unknown or other
  misc_difference 791: note = a, t, c, g, unknown or other
  misc_difference 792: note = a, t, c, g, unknown or other
  misc_difference 793: note = a, t, c, g, unknown or other
  misc_difference 794: note = a, t, c, g, unknown or other
  misc_difference 795: note = a, t, c, g, unknown or other
  misc_difference 796: note = a, t, c, g, unknown or other
  misc_difference 797: note = a, t, c, g, unknown or other
  misc_difference 798: note = a, t, c, g, unknown or other
  misc_difference 799: note = a, t, c, g, unknown or other
  misc_difference 800: note = a, t, c, g, unknown or other
  misc_difference 801: note = a, t, c, g, unknown or other
  misc_difference 802: note = a, t, c, g, unknown or other
  misc_difference 803: note = a, t, c, g, unknown or other
  misc_difference 804: note = a, t, c, g, unknown or other
  misc_difference 805: note = a, t, c, g, unknown or other
  misc_difference 806: note = a, t, c, g, unknown or other
  misc_difference 807: note = a, t, c, g, unknown or other
  misc_difference 808: note = a, t, c, g, unknown or other
  misc_difference 809: note = a, t, c, g, unknown or other
  misc_difference 810: note = a, t, c, g, unknown or other
  misc_difference 811: note = a, t, c, g, unknown or other
  misc_difference 812: note = a, t, c, g, unknown or other
  misc_difference 813: note = a, t, c, g, unknown or other
  misc_difference 814: note = a, t, c, g, unknown or other
  misc_difference 815: note = a, t, c, g, unknown or other
  misc_difference 816: note = a, t, c, g, unknown or other
  misc_difference 817: note = a, t, c, g, unknown or other
  misc_difference 818: note = a, t, c, g, unknown or other
  misc_difference 819: note = a, t, c, g, unknown or other
  misc_difference 820: note = a, t, c, g, unknown or other
  misc_difference 821: note = a, t, c, g, unknown or other
  misc_difference 822: note = a, t, c, g, unknown or other
  misc_difference 823: note = a, t, c, g, unknown or other
  misc_difference 824: note = a, t, c, g, unknown or other
  misc_difference 825: note = a, t, c, g, unknown or other
  misc_difference 826: note = a, t, c, g, unknown or other
  misc_difference 827: note = a, t, c, g, unknown or other
  misc_difference 828: note = a, t, c, g, unknown or other
  misc_difference 829: note = a, t, c, g, unknown or other
  misc_difference 830: note = a, t, c, g, unknown or other
  misc_difference 831: note = a, t, c, g, unknown or other
  misc_difference 832: note = a, t, c, g, unknown or other
  misc_difference 833: note = a, t, c, g, unknown or other
  misc_difference 834: note = a, t, c, g, unknown or other
  misc_difference 835: note = a, t, c, g, unknown or other
  misc_difference 836: note = a, t, c, g, unknown or other
  misc_difference 837: note = a, t, c, g, unknown or other
  misc_difference 838: note = a, t, c, g, unknown or other
  misc_difference 839: note = a, t, c, g, unknown or other
  misc_difference 840: note = a, t, c, g, unknown or other
  misc_difference 841: note = a, t, c, g, unknown or other
  misc_difference 842: note = a, t, c, g, unknown or other
  misc_difference 843: note = a, t, c, g, unknown or other
  misc_difference 844: note = a, t, c, g, unknown or other
  misc_difference 845: note = a, t, c, g, unknown or other
  misc_difference 846: note = a, t, c, g, unknown or other
  misc_difference 847: note = a, t, c, g, unknown or other
  misc_difference 848: note = a, t, c, g, unknown or other
  misc_difference 849: note = a, t, c, g, unknown or other
  misc_difference 850: note = a, t, c, g, unknown or other
  misc_difference 851: note = a, t, c, g, unknown or other
  misc_difference 852: note = a, t, c, g, unknown or other
  misc_difference 853: note = a, t, c, g, unknown or other
  misc_difference 854: note = a, t, c, g, unknown or other
  misc_difference 855: note = a, t, c, g, unknown or other
  misc_difference 856: note = a, t, c, g, unknown or other
  misc_difference 857: note = a, t, c, g, unknown or other
  misc_difference 858: note = a, t, c, g, unknown or other
  misc_difference 859: note = a, t, c, g, unknown or other
  misc_difference 860: note = a, t, c, g, unknown or other
  misc_difference 861: note = a, t, c, g, unknown or other
  misc_difference 862: note = a, t, c, g, unknown or other
  misc_difference 863: note = a, t, c, g, unknown or other
  misc_difference 864: note = a, t, c, g, unknown or other
  misc_difference 865: note = a, t, c, g, unknown or other
  misc_difference 866: note = a, t, c, g, unknown or other
  misc_difference 867: note = a, t, c, g, unknown or other
  misc_difference 868: note = a, t, c, g, unknown or other
  misc_difference 869: note = a, t, c, g, unknown or other
  misc_difference 870: note = a, t, c, g, unknown or other
  misc_difference 871: note = a, t, c, g, unknown or other
  misc_difference 872: note = a, t, c, g, unknown or other
  misc_difference 873: note = a, t, c, g, unknown or other
  misc_difference 874: note = a, t, c, g, unknown or other
  misc_difference 875: note = a, t, c, g, unknown or other
  misc_difference 876: note = a, t, c, g, unknown or other
  misc_difference 877: note = a, t, c, g, unknown or other
  misc_difference 878: note = a, t, c, g, unknown or other
  misc_difference 879: note = a, t, c, g, unknown or other
  misc_difference 880: note = a, t, c, g, unknown or other
  misc_difference 881: note = a, t, c, g, unknown or other
  misc_difference 882: note = a, t, c, g, unknown or other
  misc_difference 883: note = a, t, c, g, unknown or other
  misc_difference 884: note = a, t, c, g, unknown or other
  misc_difference 885: note = a, t, c, g, unknown or other
  misc_difference 886: note = a, t, c, g, unknown or other
  misc_difference 887: note = a, t, c, g, unknown or other
  misc_difference 888: note = a, t, c, g, unknown or other
  misc_difference 889: note = a, t, c, g, unknown or other
  misc_difference 890: note = a, t, c, g, unknown or other
  misc_difference 891: note = a, t, c, g, unknown or other
  misc_difference 892: note = a, t, c, g, unknown or other
  misc_difference 893: note = a, t, c, g, unknown or other
  misc_difference 894: note = a, t, c, g, unknown or other
  misc_difference 895: note = a, t, c, g, unknown or other
  misc_difference 896: note = a, t, c, g, unknown or other
  misc_difference 897: note = a, t, c, g, unknown or other
  misc_difference 898: note = a, t, c, g, unknown or other
  misc_difference 899: note = a, t, c, g, unknown or other
  misc_difference 900: note = a, t, c, g, unknown or other
  misc_difference 901: note = a, t, c, g, unknown or other
  misc_difference 902: note = a, t, c, g, unknown or other
  misc_difference 903: note = a, t, c, g, unknown or other
  misc_difference 904: note = a, t, c, g, unknown or other
  misc_difference 905: note = a, t, c, g, unknown or other
  misc_difference 906: note = a, t, c, g, unknown or other
  misc_difference 907: note = a, t, c, g, unknown or other
  misc_difference 908: note = a, t, c, g, unknown or other
  misc_difference 909: note = a, t, c, g, unknown or other
  misc_difference 910: note = a, t, c, g, unknown or other
  misc_difference 911: note = a, t, c, g, unknown or other
  misc_difference 912: note = a, t, c, g, unknown or other
  misc_difference 913: note = a, t, c, g, unknown or other
  misc_difference 914: note = a, t, c, g, unknown or other
  misc_difference 915: note = a, t, c, g, unknown or other
  misc_difference 916: note = a, t, c, g, unknown or other
  misc_difference 917: note = a, t, c, g, unknown or other
  misc_difference 918: note = a, t, c, g, unknown or other
  misc_difference 919: note = a, t, c, g, unknown or other
  misc_difference 920: note = a, t, c, g, unknown or other
  misc_difference 921: note = a, t, c, g, unknown or other
  misc_difference 922: note = a, t, c, g, unknown or other
  misc_difference 923: note = a, t, c, g, unknown or other
  misc_difference 924: note = a, t, c, g, unknown or other
  misc_difference 925: note = a, t, c, g, unknown or other
  misc_difference 926: note = a, t, c, g, unknown or other
  misc_difference 927: note = a, t, c, g, unknown or other
  misc_difference 928: note = a, t, c, g, unknown or other
  misc_difference 929: note = a, t, c, g, unknown or other
  misc_difference 930: note = a, t, c, g, unknown or other
  misc_difference 931: note = a, t, c, g, unknown or other
  misc_difference 932: note = a, t, c, g, unknown or other
  misc_difference 933: note = a, t, c, g, unknown or other
  misc_difference 934: note = a, t, c, g, unknown or other
  misc_difference 935: note = a, t, c, g, unknown or other
  misc_difference 936: note = a, t, c, g, unknown or other
  misc_difference 937: note = a, t, c, g, unknown or other
  misc_difference 938: note = a, t, c, g, unknown or other
  misc_difference 939: note = a, t, c, g, unknown or other
  misc_difference 940: note = a, t, c, g, unknown or other
  misc_difference 941: note = a, t, c, g, unknown or other
  misc_difference 942: note = a, t, c, g, unknown or other
  misc_difference 943: note = a, t, c, g, unknown or other
  misc_difference 944: note = a, t, c, g, unknown or other
  misc_difference 945: note = a, t, c, g, unknown or other
  misc_difference 946: note = a, t, c, g, unknown or other
  misc_difference 947: note = a, t, c, g, unknown or other
  misc_difference 948: note = a, t, c, g, unknown or other
  misc_difference 949: note = a, t, c, g, unknown or other
  misc_difference 950: note = a, t, c, g, unknown or other
  misc_difference 951: note = a, t, c, g, unknown or other
  misc_difference 952: note = a, t, c, g, unknown or other
  misc_difference 953: note = a, t, c, g, unknown or other
  misc_difference 954: note = a, t, c, g, unknown or other
  misc_difference 955: note = a, t, c, g, unknown or other
  misc_difference 956: note = a, t, c, g, unknown or other
  misc_difference 957: note = a, t, c, g, unknown or other
  misc_difference 958: note = a, t, c, g, unknown or other
  misc_difference 959: note = a, t, c, g, unknown or other
  misc_difference 960: note = a, t, c, g, unknown or other
  misc_difference 961: note = a, t, c, g, unknown or other
  misc_difference 962: note = a, t, c, g, unknown or other
  misc_difference 963: note = a, t, c, g, unknown or other
  misc_difference 964: note = a, t, c, g, unknown or other
  misc_difference 965: note = a, t, c, g, unknown or other
  misc_difference 966: note = a, t, c, g, unknown or other
  misc_difference 967: note = a, t, c, g, unknown or other
  misc_difference 968: note = a, t, c, g, unknown or other
  misc_difference 969: note = a, t, c, g, unknown or other
  misc_difference 970: note = a, t, c, g, unknown or other
  misc_difference 971: note = a, t, c, g, unknown or other
  misc_difference 972: note = a, t, c, g, unknown or other
  misc_difference 973: note = a, t, c, g, unknown or other
  misc_difference 974: note = a, t, c, g, unknown or other
  misc_difference 975: note = a, t, c, g, unknown or other
  misc_difference 976: note = a, t, c, g, unknown or other
  misc_difference 977: note = a, t, c, g, unknown or other
  misc_difference 978: note = a, t, c, g, unknown or other
  misc_difference 979: note = a, t, c, g, unknown or other
  misc_difference 980: note = a, t, c, g, unknown or other
  misc_difference 981: note = a, t, c, g, unknown or other
  misc_difference 982: note = a, t, c, g, unknown or other
  misc_difference 983: note = a, t, c, g, unknown or other
  misc_difference 984: note = a, t, c, g, unknown or other
  misc_difference 985: note = a, t, c, g, unknown or other
  misc_difference 986: note = a, t, c, g, unknown or other
  misc_difference 987: note = a, t, c, g, unknown or other
  misc_difference 988: note = a, t, c, g, unknown or other
  misc_difference 989: note = a, t, c, g, unknown or other
  misc_difference 990: note = a, t, c, g, unknown or other
  misc_difference 991: note = a, t, c, g, unknown or other
  misc_difference 992: note = a, t, c, g, unknown or other
  misc_difference 993: note = a, t, c, g, unknown or other
  misc_difference 994: note = a, t, c, g, unknown or other
  misc_difference 995: note = a, t, c, g, unknown or other
  misc_difference 996: note = a, t, c, g, unknown or other
  misc_difference 997: note = a, t, c, g, unknown or other
  misc_difference 998: note = a, t, c, g, unknown or other
  misc_difference 999: note = a, t, c, g, unknown or other
  misc_difference 1000: note = a, t, c, g, unknown or other
  misc_difference 1001..1019: note = a, t, c, g, unknown or other
acagtcagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7 - DNA, 1033 bp, synthetic construct
  source 1..1033: mol_type = other DNA
  misc_difference 1: note = a, t, c, g, unknown or other
  misc_difference 2: note = a, t, c, g, unknown or other
  misc_difference 3: note = a, t, c, g, unknown or other
  misc_difference 4: note = a, t, c, g, unknown or other
  misc_difference 5: note = a, t, c, g, unknown or other
  misc_difference 6: note = a, t, c, g, unknown or other
  misc_difference 7: note = a, t, c, g, unknown or other
  misc_difference 8: note = a, t, c, g, unknown or other
  misc_difference 9: note = a, t, c, g, unknown or other
  misc_difference 10: note = a, t, c, g, unknown or other
  misc_difference 11: note = a, t, c, g, unknown or other
  misc_difference 12: note = a, t, c, g, unknown or other
  misc_difference 13: note = a, t, c, g, unknown or other
  misc_difference 14: note = a, t, c, g, unknown or other
  misc_difference 15: note = a, t, c, g, unknown or other
  misc_difference 16: note = a, t, c, g, unknown or other
  misc_difference 17: note = a, t, c, g, unknown or other
  misc_difference 18: note = a, t, c, g, unknown or other
  misc_difference 19: note = a, t, c, g, unknown or other
  misc_difference 20: note = a, t, c, g, unknown or other
  misc_difference 21: note = a, t, c, g, unknown or other
  misc_difference 22: note = a, t, c, g, unknown or other
  misc_difference 23: note = a, t, c, g, unknown or other
  misc_difference 24: note = a, t, c, g, unknown or other
  misc_difference 25: note = a, t, c, g, unknown or other
  misc_difference 26: note = a, t, c, g, unknown or other
  misc_difference 27: note = a, t, c, g, unknown or other
  misc_difference 28: note = a, t, c, g, unknown or other
  misc_difference 29: note = a, t, c, g, unknown or other
  misc_difference 30: note = a, t, c, g, unknown or other
  misc_difference 31: note = a, t, c, g, unknown or other
  misc_difference 32: note = a, t, c, g, unknown or other
  misc_difference 33: note = a, t, c, g, unknown or other
  misc_difference 34: note = a, t, c, g, unknown or other
  misc_difference 35: note = a, t, c, g, unknown or other
  misc_difference 36: note = a, t, c, g, unknown or other
  misc_difference 37: note = a, t, c, g, unknown or other
  misc_difference 38: note = a, t, c, g, unknown or other
  misc_difference 39: note = a, t, c, g, unknown or other
  misc_difference 40: note = a, t, c, g, unknown or other
  misc_difference 41: note = a, t, c, g, unknown or other
  misc_difference 42: note = a, t, c, g, unknown or other
  misc_difference 43: note = a, t, c, g, unknown or other
  misc_difference 44: note = a, t, c, g, unknown or other
  misc_difference 45: note = a, t, c, g, unknown or other
  misc_difference 46: note = a, t, c, g, unknown or other
  misc_difference 47: note = a, t, c, g, unknown or other
  misc_difference 48: note = a, t, c, g, unknown or other
  misc_difference 49: note = a, t, c, g, unknown or other
  misc_difference 50: note = a, t, c, g, unknown or other
  misc_difference 51: note = a, t, c, g, unknown or other
  misc_difference 52: note = a, t, c, g, unknown or other
  misc_difference 53: note = a, t, c, g, unknown or other
  misc_difference 54: note = a, t, c, g, unknown or other
  misc_difference 55: note = a, t, c, g, unknown or other
  misc_difference 56: note = a, t, c, g, unknown or other
  misc_difference 57: note = a, t, c, g, unknown or other
  misc_difference 58: note = a, t, c, g, unknown or other
  misc_difference 59: note = a, t, c, g, unknown or other
  misc_difference 60: note = a, t, c, g, unknown or other
  misc_difference 61: note = a, t, c, g, unknown or other
  misc_difference 62: note = a, t, c, g, unknown or other
  misc_difference 63: note = a, t, c, g, unknown or other
  misc_difference 64: note = a, t, c, g, unknown or other
  misc_difference 65: note = a, t, c, g, unknown or other
  misc_difference 66: note = a, t, c, g, unknown or other
  misc_difference 67: note = a, t, c, g, unknown or other
  misc_difference 68: note = a, t, c, g, unknown or other
  misc_difference 69: note = a, t, c, g, unknown or other
  misc_difference 70: note = a, t, c, g, unknown or other
  misc_difference 71: note = a, t, c, g, unknown or other
  misc_difference 72: note = a, t, c, g, unknown or other
  misc_difference 73: note = a, t, c, g, unknown or other
  misc_difference 74: note = a, t, c, g, unknown or other
  misc_difference 75: note = a, t, c, g, unknown or other
  misc_difference 76: note = a, t, c, g, unknown or other
  misc_difference 77: note = a, t, c, g, unknown or other
  misc_difference 78: note = a, t, c, g, unknown or other
  misc_difference 79: note = a, t, c, g, unknown or other
  misc_difference 80: note = a, t, c, g, unknown or other
  misc_difference 81: note = a, t, c, g, unknown or other
  misc_difference 82: note = a, t, c, g, unknown or other
  misc_difference 83: note = a, t, c, g, unknown or other
  misc_difference 84: note = a, t, c, g, unknown or other
  misc_difference 85: note = a, t, c, g, unknown or other
  misc_difference 86: note = a, t, c, g, unknown or other
  misc_difference 87: note = a, t, c, g, unknown or other
  misc_difference 88: note = a, t, c, g, unknown or other
  misc_difference 89: note = a, t, c, g, unknown or other
  misc_difference 90: note = a, t, c, g, unknown or other
  misc_difference 91: note = a, t, c, g, unknown or other
  misc_difference 92: note = a, t, c, g, unknown or other
  misc_difference 93: note = a, t, c, g, unknown or other
  misc_difference 94: note = a, t, c, g, unknown or other
  misc_difference 95: note = a, t, c, g, unknown or other
  misc_difference 96: note = a, t, c, g, unknown or other
  misc_difference 97: note = a, t, c, g, unknown or other
  misc_difference 98: note = a, t, c, g, unknown or other
  misc_difference 99: note = a, t, c, g, unknown or other
  misc_difference 100: note = a, t, c, g, unknown or other
  misc_difference 101: note = a, t, c, g, unknown or other
  misc_difference 102: note = a, t, c, g, unknown or other
  misc_difference 103: note = a, t, c, g, unknown or other
  misc_difference 104: note = a, t, c, g, unknown or other
  misc_difference 105: note = a, t, c, g, unknown or other
  misc_difference 106: note = a, t, c, g, unknown or other
  misc_difference 107: note = a, t, c, g, unknown or other
  misc_difference 108: note = a, t, c, g, unknown or other
  misc_difference 109: note = a, t, c, g, unknown or other
  misc_difference 110: note = a, t, c, g, unknown or other
  misc_difference 111: note = a, t, c, g, unknown or other
  misc_difference 112: note = a, t, c, g, unknown or other
  misc_difference 113: note = a, t, c, g, unknown or other
  misc_difference 114: note = a, t, c, g, unknown or other
  misc_difference 115: note = a, t, c, g, unknown or other
  misc_difference 116: note = a, t, c, g, unknown or other
  misc_difference 117: note = a, t, c, g, unknown or other
  misc_difference 118: note = a, t, c, g, unknown or other
  misc_difference 119: note = a, t, c, g, unknown or other
  misc_difference 120: note = a, t, c, g, unknown or other
  misc_difference 121: note = a, t, c, g, unknown or other
  misc_difference 122: note = a, t, c, g, unknown or other
  misc_difference 123: note = a, t, c, g, unknown or other
  misc_difference 124: note = a, t, c, g, unknown or other
  misc_difference 125: note = a, t, c, g, unknown or other
  misc_difference 126: note = a, t, c, g, unknown or other
  misc_difference 127: note = a, t, c, g, unknown or other
  misc_difference 128: note = a, t, c, g, unknown or other
  misc_difference 129: note = a, t, c, g, unknown or other
  misc_difference 130: note = a, t, c, g, unknown or other
  misc_difference 131: note = a, t, c, g, unknown or other
  misc_difference 132: note = a, t, c, g, unknown or other
  misc_difference 133: note = a, t, c, g, unknown or other
  misc_difference 134: note = a, t, c, g, unknown or other
  misc_difference 135: note = a, t, c, g, unknown or other
  misc_difference 136: note = a, t, c, g, unknown or other
  misc_difference 137: note = a, t, c, g, unknown or other
  misc_difference 138: note = a, t, c, g, unknown or other
  misc_difference 139: note = a, t, c, g, unknown or other
  misc_difference 140: note = a, t, c, g, unknown or other
  misc_difference 141: note = a, t, c, g, unknown or other
  misc_difference 142: note = a, t, c, g, unknown or other
  misc_difference 143: note = a, t, c, g, unknown or other
  misc_difference 144: note = a, t, c, g, unknown or other
  misc_difference 145: note = a, t, c, g, unknown or other
  misc_difference 146: note = a, t, c, g, unknown or other
  misc_difference 147: note = a, t, c, g, unknown or other
  misc_difference 148: note = a, t, c, g, unknown or other
  misc_difference 149: note = a, t, c, g, unknown or other
  misc_difference 150: note = a, t, c, g, unknown or other
  misc_difference 151: note = a, t, c, g, unknown or other
  misc_difference 152: note = a, t, c, g, unknown or other
  misc_difference 153: note = a, t, c, g, unknown or other
  misc_difference 154: note = a, t, c, g, unknown or other
  misc_difference 155: note = a, t, c, g, unknown or other
  misc_difference 156: note = a, t, c, g, unknown or other
  misc_difference 157: note = a, t, c, g, unknown or other
  misc_difference 158: note = a, t, c, g, unknown or other
  misc_difference 159: note = a, t, c, g, unknown or other
  misc_difference 160: note = a, t, c, g, unknown or other
  misc_difference 161: note = a, t, c, g, unknown or other
  misc_difference 162: note = a, t, c, g, unknown or other
  misc_difference 163: note = a, t, c, g, unknown or other
  misc_difference 164: note = a, t, c, g, unknown or other
  misc_difference 165: note = a, t, c, g, unknown or other
  misc_difference 166: note = a, t, c, g, unknown or other
  misc_difference 167: note = a, t, c, g, unknown or other
  misc_difference 168: note = a, t, c, g, unknown or other
  misc_difference 169: note = a, t, c, g, unknown or other
  misc_difference 170: note = a, t, c, g, unknown or other
  misc_difference 171: note = a, t, c, g, unknown or other
  misc_difference 172: note = a, t, c, g, unknown or other
  misc_difference 173: note = a, t, c, g, unknown or other
  misc_difference 174: note = a, t, c, g, unknown or other
  misc_difference 175: note = a, t, c, g, unknown or other
  misc_difference 176: note = a, t, c, g, unknown or other
  misc_difference 177: note = a, t, c, g, unknown or other
  misc_difference 178: note = a, t, c, g, unknown or other
  misc_difference 179: note = a, t, c, g, unknown or other
  misc_difference 180: note = a, t, c, g, unknown or other
  misc_difference 181: note = a, t, c, g, unknown or other
  misc_difference 182: note = a, t, c, g, unknown or other
  misc_difference 183: note = a, t, c, g, unknown or other
  misc_difference 184: note = a, t, c, g, unknown or other
  misc_difference 185: note = a, t, c, g, unknown or other
  misc_difference 186: note = a, t, c, g, unknown or other
  misc_difference 187: note = a, t, c, g, unknown or other
  misc_difference 188: note = a, t, c, g, unknown or other
  misc_difference 189: note = a, t, c, g, unknown or other
  misc_difference 190: note = a, t, c, g, unknown or other
  misc_difference 191: note = a, t, c, g, unknown or other
  misc_difference 192: note = a, t, c, g, unknown or other
  misc_difference 193: note = a, t, c, g, unknown or other
  misc_difference 194: note = a, t, c, g, unknown or other
  misc_difference 195: note = a, t, c, g, unknown or other
  misc_difference 196: note = a, t, c, g, unknown or other
  misc_difference 197: note = a, t, c, g, unknown or other
  misc_difference 198: note = a, t, c, g, unknown or other
  misc_difference 199: note = a, t, c, g, unknown or other
  misc_difference 200: note = a, t, c, g, unknown or other
  misc_difference 201: note = a, t, c, g, unknown or other
  misc_difference 202: note = a, t, c, g, unknown or other
  misc_difference 203: note = a, t, c, g, unknown or other
  misc_difference 204: note = a, t, c, g, unknown or other
  misc_difference 205: note = a, t, c, g, unknown or other
  misc_difference 206: note = a, t, c, g, unknown or other
  misc_difference 207: note = a, t, c, g, unknown or other
  misc_difference 208: note = a, t, c, g, unknown or other
  misc_difference 209: note = a, t, c, g, unknown or other
  misc_difference 210: note = a, t, c, g, unknown or other
  misc_difference 211: note = a, t, c, g, unknown or other
  misc_difference 212: note = a, t, c, g, unknown or other
  misc_difference 213: note = a, t, c, g, unknown or other
  misc_difference 214: note = a, t, c, g, unknown or other
  misc_difference 215: note = a, t, c, g, unknown or other
  misc_difference 216: note = a, t, c, g, unknown or other
  misc_difference 217: note = a, t, c, g, unknown or other
  misc_difference 218: note = a, t, c, g, unknown or other
  misc_difference 219: note = a, t, c, g, unknown or other
  misc_difference 220: note = a, t, c, g, unknown or other
  misc_difference 221: note = a, t, c, g, unknown or other
  misc_difference 222: note = a, t, c, g, unknown or other
  misc_difference 223: note = a, t, c, g, unknown or other
  misc_difference 224: note = a, t, c, g, unknown or other
  misc_difference 225: note = a, t, c, g, unknown or other
  misc_difference 226: note = a, t, c, g, unknown or other
  misc_difference 227: note = a, t, c, g, unknown or other
  misc_difference 228: note = a, t, c, g, unknown or other
  misc_difference 229: note = a, t, c, g, unknown or other
  misc_difference 230: note = a, t, c, g, unknown or other
  misc_difference 231: note = a, t, c, g, unknown or other
  misc_difference 232: note = a, t, c, g, unknown or other
  misc_difference 233: note = a, t, c, g, unknown or other
  misc_difference 234: note = a, t, c, g, unknown or other
  misc_difference 235: note = a, t, c, g, unknown or other
  misc_difference 236: note = a, t, c, g, unknown or other
  misc_difference 237: note = a, t, c, g, unknown or other
  misc_difference 238: note = a, t, c, g, unknown or other
  misc_difference 239: note = a, t, c, g, unknown or other
  misc_difference 240: note = a, t, c, g, unknown or other
  misc_difference 241: note = a, t, c, g, unknown or other
  misc_difference 242: note = a, t, c, g, unknown or other
  misc_difference 243: note = a, t, c, g, unknown or other
  misc_difference 244: note = a, t, c, g, unknown or other
  misc_difference 245: note = a, t, c, g, unknown or other
  misc_difference 246: note = a, t, c, g, unknown or other
  misc_difference 247: note = a, t, c, g, unknown or other
  misc_difference 248: note = a, t, c, g, unknown or other
  misc_difference 249: note = a, t, c, g, unknown or other
  misc_difference 250: note = a, t, c, g, unknown or other
  misc_difference 251: note = a, t, c, g, unknown or other
  misc_difference 252: note = a, t, c, g, unknown or other
  misc_difference 253: note = a, t, c, g, unknown or other
  misc_difference 254: note = a, t, c, g, unknown or other
  misc_difference 255: note = a, t, c, g, unknown or other
  misc_difference 256: note = a, t, c, g, unknown or other
  misc_difference 257: note = a, t, c, g, unknown or other
  misc_difference 258: note = a, t, c, g, unknown or other
  misc_difference 259: note = a, t, c, g, unknown or other
  misc_difference 260: note = a, t, c, g, unknown or other
  misc_difference 261: note = a, t, c, g, unknown or other
  misc_difference 262: note = a, t, c, g, unknown or other
  misc_difference 263: note = a, t, c, g, unknown or other
  misc_difference 264: note = a, t, c, g, unknown or other
  misc_difference 265: note = a, t, c, g, unknown or other
  misc_difference 266: note = a, t, c, g, unknown or other
  misc_difference 267: note = a, t, c, g, unknown or other
  misc_difference 268: note = a, t, c, g, unknown or other
  misc_difference 269: note = a, t, c, g, unknown or other
  misc_difference 270: note = a, t, c, g, unknown or other
  misc_difference 271: note = a, t, c, g, unknown or other
  misc_difference 272: note = a, t, c, g, unknown or other
  misc_difference 273: note = a, t, c, g, unknown or other
  misc_difference 274: note = a, t, c, g, unknown or other
  misc_difference 275: note = a, t, c, g, unknown or other
  misc_difference 276: note = a, t, c, g, unknown or other
  misc_difference 277: note = a, t, c, g, unknown or other
  misc_difference 278: note = a, t, c, g, unknown or other
  misc_difference 279: note = a, t, c, g, unknown or other
  misc_difference 280: note = a, t, c, g, unknown or other
  misc_difference 281: note = a, t, c, g, unknown or other
  misc_difference 282: note = a, t, c, g, unknown or other
  misc_difference 283: note = a, t, c, g, unknown or other
  misc_difference 284: note = a, t, c, g, unknown or other
  misc_difference 285: note = a, t, c, g, unknown or other
  misc_difference 286: note = a, t, c, g, unknown or other
  misc_difference 287: note = a, t, c, g, unknown or other
  misc_difference 288: note = a, t, c, g, unknown or other
  misc_difference 289: note = a, t, c, g, unknown or other
  misc_difference 290: note = a, t, c, g, unknown or other
  misc_difference 291: note = a, t, c, g, unknown or other
  misc_difference 292: note = a, t, c, g, unknown or other
  misc_difference 293: note = a, t, c, g, unknown or other
  misc_difference 294: note = a, t, c, g, unknown or other
  misc_difference 295: note = a, t, c, g, unknown or other
  misc_difference 296: note = a, t, c, g, unknown or other
  misc_difference 297: note = a, t, c, g, unknown or other
  misc_difference 298: note = a, t, c, g, unknown or other
  misc_difference 299: note = a, t, c, g, unknown or other
  misc_difference 300: note = a, t, c, g, unknown or other
  misc_difference 301: note = a, t, c, g, unknown or other
  misc_difference 302: note = a, t, c, g, unknown or other
  misc_difference 303: note = a, t, c, g, unknown or other
  misc_difference 304: note = a, t, c, g, unknown or other
  misc_difference 305: note = a, t, c, g, unknown or other
  misc_difference 306: note = a, t, c, g, unknown or other
  misc_difference 307: note = a, t, c, g, unknown or other
  misc_difference 308: note = a, t, c, g, unknown or other
  misc_difference 309: note = a, t, c, g, unknown or other
  misc_difference 310: note = a, t, c, g, unknown or other
  misc_difference 311: note = a, t, c, g, unknown or other
  misc_difference 312: note = a, t, c, g, unknown or other
  misc_difference 313: note = a, t, c, g, unknown or other
  misc_difference 314: note = a, t, c, g, unknown or other
  misc_difference 315: note = a, t, c, g, unknown or other
  misc_difference 316: note = a, t, c, g, unknown or other
  misc_difference 317: note = a, t, c, g, unknown or other
  misc_difference 318: note = a, t, c, g, unknown or other
  misc_difference 319: note = a, t, c, g, unknown or other
  misc_difference 320: note = a, t, c, g, unknown or other
  misc_difference 321: note = a, t, c, g, unknown or other
  misc_difference 322: note = a, t, c, g, unknown or other
  misc_difference 323: note = a, t, c, g, unknown or other
  misc_difference 324: note = a, t, c, g, unknown or other
  misc_difference 325: note = a, t, c, g, unknown or other
  misc_difference 326: note = a, t, c, g, unknown or other
  misc_difference 327: note = a, t, c, g, unknown or other
  misc_difference 328: note = a, t, c, g, unknown or other
  misc_difference 329: note = a, t, c, g, unknown or other
  misc_difference 330: note = a, t, c, g, unknown or other
  misc_difference 331: note = a, t, c, g, unknown or other
  misc_difference 332: note = a, t, c, g, unknown or other
  misc_difference 333: note = a, t, c, g, unknown or other
  misc_difference 334: note = a, t, c, g, unknown or other
  misc_difference 335: note = a, t, c, g, unknown or other
  misc_difference 336: note = a, t, c, g, unknown or other
  misc_difference 337: note = a, t, c, g, unknown or other
  misc_difference 338: note = a, t, c, g, unknown or other
  misc_difference 339: note = a, t, c, g, unknown or other
  misc_difference 340: note = a, t, c, g, unknown or other
  misc_difference 341: note = a, t, c, g, unknown or other
  misc_difference 342: note = a, t, c, g, unknown or other
  misc_difference 343: note = a, t, c, g, unknown or other
  misc_difference 344: note = a, t, c, g, unknown or other
  misc_difference 345: note = a, t, c, g, unknown or other
  misc_difference 346: note = a, t, c, g, unknown or other
  misc_difference 347: note = a, t, c, g, unknown or other
  misc_difference 348: note = a, t, c, g, unknown or other
  misc_difference 349: note = a, t, c, g, unknown or other
  misc_difference 350: note = a, t, c, g, unknown or other
  misc_difference 351: note = a, t, c, g, unknown or other
  misc_difference 352: note = a, t, c, g, unknown or other
  misc_difference 353: note = a, t, c, g, unknown or other
  misc_difference 354: note = a, t, c, g, unknown or other
  misc_difference 355: note = a, t, c, g, unknown or other
  misc_difference 356: note = a, t, c, g, unknown or other
  misc_difference 357: note = a, t, c, g, unknown or other
  misc_difference 358: note = a, t, c, g, unknown or other
  misc_difference 359: note = a, t, c, g, unknown or other
  misc_difference 360: note = a, t, c, g, unknown or other
  misc_difference 361: note = a, t, c, g, unknown or other
  misc_difference 362: note = a, t, c, g, unknown or other
  misc_difference 363: note = a, t, c, g, unknown or other
  misc_difference 364: note = a, t, c, g, unknown or other
  misc_difference 365: note = a, t, c, g, unknown or other
  misc_difference 366: note = a, t, c, g, unknown or other
  misc_difference 367: note = a, t, c, g, unknown or other
  misc_difference 368: note = a, t, c, g, unknown or other
  misc_difference 369: note = a, t, c, g, unknown or other
  misc_difference 370: note = a, t, c, g, unknown or other
  misc_difference 371: note = a, t, c, g, unknown or other
  misc_difference 372: note = a, t, c, g, unknown or other
  misc_difference 373: note = a, t, c, g, unknown or other
  misc_difference 374: note = a, t, c, g, unknown or other
  misc_difference 375: note = a, t, c, g, unknown or other
  misc_difference 376: note = a, t, c, g, unknown or other
  misc_difference 377: note = a, t, c, g, unknown or other
  misc_difference 378: note = a, t, c, g, unknown or other
  misc_difference 379: note = a, t, c, g, unknown or other
  misc_difference 380: note = a, t, c, g, unknown or other
  misc_difference 381: note = a, t, c, g, unknown or other
  misc_difference 382: note = a, t, c, g, unknown or other
  misc_difference 383: note = a, t, c, g, unknown or other
  misc_difference 384: note = a, t, c, g, unknown or other
  misc_difference 385: note = a, t, c, g, unknown or other
  misc_difference 386: note = a, t, c, g, unknown or other
  misc_difference 387: note = a, t, c, g, unknown or other
  misc_difference 388: note = a, t, c, g, unknown or other
  misc_difference 389: note = a, t, c, g, unknown or other
  misc_difference 390: note = a, t, c, g, unknown or other
  misc_difference 391: note = a, t, c, g, unknown or other
  misc_difference 392: note = a, t, c, g, unknown or other
  misc_difference 393: note = a, t, c, g, unknown or other
  misc_difference 394: note = a, t, c, g, unknown or other
  misc_difference 395: note = a, t, c, g, unknown or other
  misc_difference 396: note = a, t, c, g, unknown or other
  misc_difference 397: note = a, t, c, g, unknown or other
  misc_difference 398: note = a, t, c, g, unknown or other
  misc_difference 399: note = a, t, c, g, unknown or other
  misc_difference 400: note = a, t, c, g, unknown or other
  misc_difference 401: note = a, t, c, g, unknown or other
  misc_difference 402: note = a, t, c, g, unknown or other
  misc_difference 403: note = a, t, c, g, unknown or other
  misc_difference 404: note = a, t, c, g, unknown or other
  misc_difference 405: note = a, t, c, g, unknown or other
  misc_difference 406: note = a, t, c, g, unknown or other
  misc_difference 407: note = a, t, c, g, unknown or other
  misc_difference 408: note = a, t, c, g, unknown or other
  misc_difference 409: note = a, t, c, g, unknown or other
  misc_difference 410: note = a, t, c, g, unknown or other
  misc_difference 411: note = a, t, c, g, unknown or other
  misc_difference 412: note = a, t, c, g, unknown or other
  misc_difference 413: note = a, t, c, g, unknown or other
  misc_difference 414: note = a, t, c, g, unknown or other
  misc_difference 415: note = a, t, c, g, unknown or other
  misc_difference 416: note = a, t, c, g, unknown or other
  misc_difference 417: note = a, t, c, g, unknown or other
  misc_difference 418: note = a, t, c, g, unknown or other
  misc_difference 419: note = a, t, c, g, unknown or other
  misc_difference 420: note = a, t, c, g, unknown or other
  misc_difference 421: note = a, t, c, g, unknown or other
  misc_difference 422: note = a, t, c, g, unknown or other
  misc_difference 423: note = a, t, c, g, unknown or other
  misc_difference 424: note = a, t, c, g, unknown or other
  misc_difference 425: note = a, t, c, g, unknown or other
  misc_difference 426: note = a, t, c, g, unknown or other
  misc_difference 427: note = a, t, c, g, unknown or other
  misc_difference 428: note = a, t, c, g, unknown or other
  misc_difference 429: note = a, t, c, g, unknown or other
  misc_difference 430: note = a, t, c, g, unknown or other
  misc_difference 431: note = a, t, c, g, unknown or other
  misc_difference 432: note = a, t, c, g, unknown or other
  misc_difference 433: note = a, t, c, g, unknown or other
  misc_difference 434: note = a, t, c, g, unknown or other
  misc_difference 435: note = a, t, c, g, unknown or other
  misc_difference 436: note = a, t, c, g, unknown or other
  misc_difference 437: note = a, t, c, g, unknown or other
  misc_difference 438: note = a, t, c, g, unknown or other
  misc_difference 439: note = a, t, c, g, unknown or other
  misc_difference 440: note = a, t, c, g, unknown or other
  misc_difference 441: note = a, t, c, g, unknown or other
  misc_difference 442: note = a, t, c, g, unknown or other
  misc_difference 443: note = a, t, c, g, unknown or other
  misc_difference 444: note = a, t, c, g, unknown or other
  misc_difference 445: note = a, t, c, g, unknown or other
  misc_difference 446: note = a, t, c, g, unknown or other
  misc_difference 447: note = a, t, c, g, unknown or other
  misc_difference 448: note = a, t, c, g, unknown or other
  misc_difference 449: note = a, t, c, g, unknown or other
  misc_difference 450: note = a, t, c, g, unknown or other
  misc_difference 451: note = a, t, c, g, unknown or other
  misc_difference 452: note = a, t, c, g, unknown or other
  misc_difference 453: note = a, t, c, g, unknown or other
  misc_difference 454: note = a, t, c, g, unknown or other
  misc_difference 455: note = a, t, c, g, unknown or other
  misc_difference 456: note = a, t, c, g, unknown or other
  misc_difference 457: note = a, t, c, g, unknown or other
  misc_difference 458: note = a, t, c, g, unknown or other
  misc_difference 459: note = a, t, c, g, unknown or other
  misc_difference 460: note = a, t, c, g, unknown or other
  misc_difference 461: note = a, t, c, g, unknown or other
  misc_difference 462: note = a, t, c, g, unknown or other
  misc_difference 463: note = a, t, c, g, unknown or other
  misc_difference 464: note = a, t, c, g, unknown or other
  misc_difference 465: note = a, t, c, g, unknown or other
  misc_difference 466: note = a, t, c, g, unknown or other
  misc_difference 467: note = a, t, c, g, unknown or other
  misc_difference 468: note = a, t, c, g, unknown or other
  misc_difference 469: note = a, t, c, g, unknown or other
  misc_difference 470: note = a, t, c, g, unknown or other
  misc_difference 471: note = a, t, c, g, unknown or other
  misc_difference 472: note = a, t, c, g, unknown or other
  misc_difference 473: note = a, t, c, g, unknown or other
  misc_difference 474: note = a, t, c, g, unknown or other
  misc_difference 475: note = a, t, c, g, unknown or other
  misc_difference 476: note = a, t, c, g, unknown or other
  misc_difference 477: note = a, t, c, g, unknown or other
  misc_difference 478: note = a, t, c, g, unknown or other
  misc_difference 479: note = a, t, c, g, unknown or other
  misc_difference 480: note = a, t, c, g, unknown or other
  misc_difference 481: note = a, t, c, g, unknown or other
  misc_difference 482: note = a, t, c, g, unknown or other
  misc_difference 483: note = a, t, c, g, unknown or other
  misc_difference 484: note = a, t, c, g, unknown or other
  misc_difference 485: note = a, t, c, g, unknown or other
  misc_difference 486: note = a, t, c, g, unknown or other
  misc_difference 487: note = a, t, c, g, unknown or other
  misc_difference 488: note = a, t, c, g, unknown or other
  misc_difference 489: note = a, t, c, g, unknown or other
  misc_difference 490: note = a, t, c, g, unknown or other
  misc_difference 491: note = a, t, c, g, unknown or other
  misc_difference 492: note = a, t, c, g, unknown or other
  misc_difference 493: note = a, t, c, g, unknown or other
  misc_difference 494: note = a, t, c, g, unknown or other
  misc_difference 495: note = a, t, c, g, unknown or other
  misc_difference 496: note = a, t, c, g, unknown or other
  misc_difference 497: note = a, t, c, g, unknown or other
  misc_difference 498: note = a, t, c, g, unknown or other
  misc_difference 499: note = a, t, c, g, unknown or other
  misc_difference 500: note = a, t, c, g, unknown or other
  misc_difference 501: note = a, t, c, g, unknown or other
  misc_difference 502: note = a, t, c, g, unknown or other
  misc_difference 503: note = a, t, c, g, unknown or other
  misc_difference 504: note = a, t, c, g, unknown or other
  misc_difference 505: note = a, t, c, g, unknown or other
  misc_difference 506: note = a, t, c, g, unknown or other
  misc_difference 507: note = a, t, c, g, unknown or other
  misc_difference 508: note = a, t, c, g, unknown or other
  misc_difference 509: note = a, t, c, g, unknown or other
  misc_difference 510: note = a, t, c, g, unknown or other
  misc_difference 511: note = a, t, c, g, unknown or other
  misc_difference 512: note = a, t, c, g, unknown or other
  misc_difference 513: note = a, t, c, g, unknown or other
  misc_difference 514: note = a, t, c, g, unknown or other
  misc_difference 515: note = a, t, c, g, unknown or other
  misc_difference 516: note = a, t, c, g, unknown or other
  misc_difference 517: note = a, t, c, g, unknown or other
  misc_difference 518: note = a, t, c, g, unknown or other
  misc_difference 519: note = a, t, c, g, unknown or other
  misc_difference 520: note = a, t, c, g, unknown or other
  misc_difference 521: note = a, t, c, g, unknown or other
  misc_difference 522: note = a, t, c, g, unknown or other
  misc_difference 523: note = a, t, c, g, unknown or other
  misc_difference 524: note = a, t, c, g, unknown or other
  misc_difference 525: note = a, t, c, g, unknown or other
  misc_difference 526: note = a, t, c, g, unknown or other
  misc_difference 527: note = a, t, c, g, unknown or other
  misc_difference 528: note = a, t, c, g, unknown or other
  misc_difference 529: note = a, t, c, g, unknown or other
  misc_difference 530: note = a, t, c, g, unknown or other
  misc_difference 531: note = a, t, c, g, unknown or other
  misc_difference 532: note = a, t, c, g, unknown or other
  misc_difference 533: note = a, t, c, g, unknown or other
  misc_difference 534: note = a, t, c, g, unknown or other
  misc_difference 535: note = a, t, c, g, unknown or other
  misc_difference 536: note = a, t, c, g, unknown or other
  misc_difference 537: note = a, t, c, g, unknown or other
  misc_difference 538: note = a, t, c, g, unknown or other
  misc_difference 539: note = a, t, c, g, unknown or other
  misc_difference 540: note = a, t, c, g, unknown or other
  misc_difference 541: note = a, t, c, g, unknown or other
  misc_difference 542: note = a, t, c, g, unknown or other
  misc_difference 543: note = a, t, c, g, unknown or other
  misc_difference 544: note = a, t, c, g, unknown or other
  misc_difference 545: note = a, t, c, g, unknown or other
  misc_difference 546: note = a, t, c, g, unknown or other
  misc_difference 547: note = a, t, c, g, unknown or other
  misc_difference 548: note = a, t, c, g, unknown or other
  misc_difference 549: note = a, t, c, g, unknown or other
  misc_difference 550: note = a, t, c, g, unknown or other
  misc_difference 551: note = a, t, c, g, unknown or other
  misc_difference 552: note = a, t, c, g, unknown or other
  misc_difference 553: note = a, t, c, g, unknown or other
  misc_difference 554: note = a, t, c, g, unknown or other
  misc_difference 555: note = a, t, c, g, unknown or other
  misc_difference 556: note = a, t, c, g, unknown or other
  misc_difference 557: note = a, t, c, g, unknown or other
  misc_difference 558: note = a, t, c, g, unknown or other
  misc_difference 559: note = a, t, c, g, unknown or other
  misc_difference 560: note = a, t, c, g, unknown or other
  misc_difference 561: note = a, t, c, g, unknown or other
  misc_difference 562: note = a, t, c, g, unknown or other
  misc_difference 563: note = a, t, c, g, unknown or other
  misc_difference 564: note = a, t, c, g, unknown or other
  misc_difference 565: note = a, t, c, g, unknown or other
  misc_difference 566: note = a, t, c, g, unknown or other
  misc_difference 567: note = a, t, c, g, unknown or other
  misc_difference 568: note = a, t, c, g, unknown or other
  misc_difference 569: note = a, t, c, g, unknown or other
  misc_difference 570: note = a, t, c, g, unknown or other
  misc_difference 571: note = a, t, c, g, unknown or other
  misc_difference 572: note = a, t, c, g, unknown or other
  misc_difference 573: note = a, t, c, g, unknown or other
  misc_difference 574: note = a, t, c, g, unknown or other
  misc_difference 575: note = a, t, c, g, unknown or other
  misc_difference 576: note = a, t, c, g, unknown or other
  misc_difference 577: note = a, t, c, g, unknown or other
  misc_difference 578: note = a, t, c, g, unknown or other
  misc_difference 579: note = a, t, c, g, unknown or other
  misc_difference 580: note = a, t, c, g, unknown or other
  misc_difference 581: note = a, t, c, g, unknown or other
  misc_difference 582: note = a, t, c, g, unknown or other
  misc_difference 583: note = a, t, c, g, unknown or other
  misc_difference 584: note = a, t, c, g, unknown or other
  misc_difference 585: note = a, t, c, g, unknown or other
  misc_difference 586: note = a, t, c, g, unknown or other
  misc_difference 587: note = a, t, c, g, unknown or other
  misc_difference 588: note = a, t, c, g, unknown or other
  misc_difference 589: note = a, t, c, g, unknown or other
  misc_difference 590: note = a, t, c, g, unknown or other
  misc_difference 591: note = a, t, c, g, unknown or other
  misc_difference 592: note = a, t, c, g, unknown or other
  misc_difference 593: note = a, t, c, g, unknown or other
  misc_difference 594: note = a, t, c, g, unknown or other
  misc_difference 595: note = a, t, c, g, unknown or other
  misc_difference 596: note = a, t, c, g, unknown or other
  misc_difference 597: note = a, t, c, g, unknown or other
  misc_difference 598: note = a, t, c, g, unknown or other
  misc_difference 599: note = a, t, c, g, unknown or other
  misc_difference 600: note = a, t, c, g, unknown or other
  misc_difference 601: note = a, t, c, g, unknown or other
  misc_difference 602: note = a, t, c, g, unknown or other
  misc_difference 603: note = a, t, c, g, unknown or other
  misc_difference 604: note = a, t, c, g, unknown or other
  misc_difference 605: note = a, t, c, g, unknown or other
  misc_difference 606: note = a, t, c, g, unknown or other
  misc_difference 607: note = a, t, c, g, unknown or other
  misc_difference 608: note = a, t, c, g, unknown or other
  misc_difference 609: note = a, t, c, g, unknown or other
  misc_difference 610: note = a, t, c, g, unknown or other
  misc_difference 611: note = a, t, c, g, unknown or other
  misc_difference 612: note = a, t, c, g, unknown or other
  misc_difference 613: note = a, t, c, g, unknown or other
  misc_difference 614: note = a, t, c, g, unknown or other
  misc_difference 615: note = a, t, c, g, unknown or other
  misc_difference 616: note = a, t, c, g, unknown or other
  misc_difference 617: note = a, t, c, g, unknown or other
  misc_difference 618: note = a, t, c, g, unknown or other
  misc_difference 619: note = a, t, c, g, unknown or other
  misc_difference 620: note = a, t, c, g, unknown or other
  misc_difference 621: note = a, t, c, g, unknown or other
  misc_difference 622: note = a, t, c, g, unknown or other
  misc_difference 623: note = a, t, c, g, unknown or other
  misc_difference 624: note = a, t, c, g, unknown or other
  misc_difference 625: note = a, t, c, g, unknown or other
  misc_difference 626: note = a, t, c, g, unknown or other
  misc_difference 627: note = a, t, c, g, unknown or other
  misc_difference 628: note = a, t, c, g, unknown or other
  misc_difference 629: note = a, t, c, g, unknown or other
  misc_difference 630: note = a, t, c, g, unknown or other
  misc_difference 631: note = a, t, c, g, unknown or other
  misc_difference 632: note = a, t, c, g, unknown or other
  misc_difference 633: note = a, t, c, g, unknown or other
  misc_difference 634: note = a, t, c, g, unknown or other
  misc_difference 635: note = a, t, c, g, unknown or other
  misc_difference 636: note = a, t, c, g, unknown or other
  misc_difference 637: note = a, t, c, g, unknown or other
  misc_difference 638: note = a, t, c, g, unknown or other
  misc_difference 639: note = a, t, c, g, unknown or other
  misc_difference 640: note = a, t, c, g, unknown or other
  misc_difference 641: note = a, t, c, g, unknown or other
  misc_difference 642: note = a, t, c, g, unknown or other
  misc_difference 643: note = a, t, c, g, unknown or other
  misc_difference 644: note = a, t, c, g, unknown or other
  misc_difference 645: note = a, t, c, g, unknown or other
  misc_difference 646: note = a, t, c, g, unknown or other
  misc_difference 647: note = a, t, c, g, unknown or other
  misc_difference 648: note = a, t, c, g, unknown or other
  misc_difference 649: note = a, t, c, g, unknown or other
  misc_difference 650: note = a, t, c, g, unknown or other
  misc_difference 651: note = a, t, c, g, unknown or other
  misc_difference 652: note = a, t, c, g, unknown or other
  misc_difference 653: note = a, t, c, g, unknown or other
  misc_difference 654: note = a, t, c, g, unknown or other
  misc_difference 655: note = a, t, c, g, unknown or other
  misc_difference 656: note = a, t, c, g, unknown or other
  misc_difference 657: note = a, t, c, g, unknown or other
  misc_difference 658: note = a, t, c, g, unknown or other
  misc_difference 659: note = a, t, c, g, unknown or other
  misc_difference 660: note = a, t, c, g, unknown or other
  misc_difference 661: note = a, t, c, g, unknown or other
  misc_difference 662: note = a, t, c, g, unknown or other
  misc_difference 663: note = a, t, c, g, unknown or other
  misc_difference 664: note = a, t, c, g, unknown or other
  misc_difference 665: note = a, t, c, g, unknown or other
  misc_difference 666: note = a, t, c, g, unknown or other
  misc_difference 667: note = a, t, c, g, unknown or other
  misc_difference 668: note = a, t, c, g, unknown or other
  misc_difference 669: note = a, t, c, g, unknown or other
  misc_difference 670: note = a, t, c, g, unknown or other
  misc_difference 671: note = a, t, c, g, unknown or other
  misc_difference 672: note = a, t, c, g, unknown or other
  misc_difference 673: note = a, t, c, g, unknown or other
  misc_difference 674: note = a, t, c, g, unknown or other
  misc_difference 675: note = a, t, c, g, unknown or other
  misc_difference 676: note = a, t, c, g, unknown or other
  misc_difference 677: note = a, t, c, g, unknown or other
  misc_difference 678: note = a, t, c, g, unknown or other
  misc_difference 679: note = a, t, c, g, unknown or other
  misc_difference 680: note = a, t, c, g, unknown or other
  misc_difference 681: note = a, t, c, g, unknown or other
  misc_difference 682: note = a, t, c, g, unknown or other
  misc_difference 683: note = a, t, c, g, unknown or other
  misc_difference 684: note = a, t, c, g, unknown or other
  misc_difference 685: note = a, t, c, g, unknown or other
  misc_difference 686: note = a, t, c, g, unknown or other
  misc_difference 687: note = a, t, c, g, unknown or other
  misc_difference 688: note = a, t, c, g, unknown or other
  misc_difference 689: note = a, t, c, g, unknown or other
  misc_difference 690: note = a, t, c, g, unknown or other
  misc_difference 691: note = a, t, c, g, unknown or other
  misc_difference 692: note = a, t, c, g, unknown or other
  misc_difference 693: note = a, t, c, g, unknown or other
  misc_difference 694: note = a, t, c, g, unknown or other
  misc_difference 695: note = a, t, c, g, unknown or other
  misc_difference 696: note = a, t, c, g, unknown or other
  misc_difference 697: note = a, t, c, g, unknown or other
  misc_difference 698: note = a, t, c, g, unknown or other
  misc_difference 699: note = a, t, c, g, unknown or other
  misc_difference 700: note = a, t, c, g, unknown or other
  misc_difference 701: note = a, t, c, g, unknown or other
  misc_difference 702: note = a, t, c, g, unknown or other
  misc_difference 703: note = a, t, c, g, unknown or other
  misc_difference 704: note = a, t, c, g, unknown or other
  misc_difference 705: note = a, t, c, g, unknown or other
  misc_difference 706: note = a, t, c, g, unknown or other
  misc_difference 707: note = a, t, c, g, unknown or other
  misc_difference 708: note = a, t, c, g, unknown or other
  misc_difference 709: note = a, t, c, g, unknown or other
  misc_difference 710: note = a, t, c, g, unknown or other
  misc_difference 711: note = a, t, c, g, unknown or other
  misc_difference 712: note = a, t, c, g, unknown or other
  misc_difference 713: note = a, t, c, g, unknown or other
  misc_difference 714: note = a, t, c, g, unknown or other
  misc_difference 715: note = a, t, c, g, unknown or other
  misc_difference 716: note = a, t, c, g, unknown or other
  misc_difference 717: note = a, t, c, g, unknown or other
  misc_difference 718: note = a, t, c, g, unknown or other
  misc_difference 719: note = a, t, c, g, unknown or other
  misc_difference 720: note = a, t, c, g, unknown or other
  misc_difference 721: note = a, t, c, g, unknown or other
  misc_difference 722: note = a, t, c, g, unknown or other
  misc_difference 723: note = a, t, c, g, unknown or other
  misc_difference 724: note = a, t, c, g, unknown or other
  misc_difference 725: note = a, t, c, g, unknown or other
  misc_difference 726: note = a, t, c, g, unknown or other
  misc_difference 727: note = a, t, c, g, unknown or other
  misc_difference 728: note = a, t, c, g, unknown or other
  misc_difference 729: note = a, t, c, g, unknown or other
  misc_difference 730: note = a, t, c, g, unknown or other
  misc_difference 731: note = a, t, c, g, unknown or other
  misc_difference 732: note = a, t, c, g, unknown or other
  misc_difference 733: note = a, t, c, g, unknown or other
  misc_difference 734: note = a, t, c, g, unknown or other
  misc_difference 735: note = a, t, c, g, unknown or other
  misc_difference 736: note = a, t, c, g, unknown or other
  misc_difference 737: note = a, t, c, g, unknown or other
  misc_difference 738: note = a, t, c, g, unknown or other
  misc_difference 739: note = a, t, c, g, unknown or other
  misc_difference 740: note = a, t, c, g, unknown or other
  misc_difference 741: note = a, t, c, g, unknown or other
  misc_difference 742: note = a, t, c, g, unknown or other
  misc_difference 743: note = a, t, c, g, unknown or other
  misc_difference 744: note = a, t, c, g, unknown or other
  misc_difference 745: note = a, t, c, g, unknown or other
  misc_difference 746: note = a, t, c, g, unknown or other
  misc_difference 747: note = a, t, c, g, unknown or other
  misc_difference 748: note = a, t, c, g, unknown or other
  misc_difference 749: note = a, t, c, g, unknown or other
  misc_difference 750: note = a, t, c, g, unknown or other
  misc_difference 751: note = a, t, c, g, unknown or other
  misc_difference 752: note = a, t, c, g, unknown or other
  misc_difference 753: note = a, t, c, g, unknown or other
  misc_difference 754: note = a, t, c, g, unknown or other
  misc_difference 755: note = a, t, c, g, unknown or other
  misc_difference 756: note = a, t, c, g, unknown or other
  misc_difference 757: note = a, t, c, g, unknown or other
  misc_difference 758: note = a, t, c, g, unknown or other
  misc_difference 759: note = a, t, c, g, unknown or other
  misc_difference 760: note = a, t, c, g, unknown or other
  misc_difference 761: note = a, t, c, g, unknown or other
  misc_difference 762: note = a, t, c, g, unknown or other
  misc_difference 763: note = a, t, c, g, unknown or other
  misc_difference 764: note = a, t, c, g, unknown or other
  misc_difference 765: note = a, t, c, g, unknown or other
  misc_difference 766: note = a, t, c, g, unknown or other
  misc_difference 767: note = a, t, c, g, unknown or other
  misc_difference 768: note = a, t, c, g, unknown or other
  misc_difference 769: note = a, t, c, g, unknown or other
  misc_difference 770: note = a, t, c, g, unknown or other
  misc_difference 771: note = a, t, c, g, unknown or other
  misc_difference 772: note = a, t, c, g, unknown or other
  misc_difference 773: note = a, t, c, g, unknown or other
  misc_difference 774: note = a, t, c, g, unknown or other
  misc_difference 775: note = a, t, c, g, unknown or other
  misc_difference 776: note = a, t, c, g, unknown or other
  misc_difference 777: note = a, t, c, g, unknown or other
  misc_difference 778: note = a, t, c, g, unknown or other
  misc_difference 779: note = a, t, c, g, unknown or other
  misc_difference 780: note = a, t, c, g, unknown or other
  misc_difference 781: note = a, t, c, g, unknown or other
  misc_difference 782: note = a, t, c, g, unknown or other
  misc_difference 783: note = a, t, c, g, unknown or other
  misc_difference 784: note = a, t, c, g, unknown or other
  misc_difference 785: note = a, t, c, g, unknown or other
  misc_difference 786: note = a, t, c, g, unknown or other
  misc_difference 787: note = a, t, c, g, unknown or other
  misc_difference 788: note = a, t, c, g, unknown or other
  misc_difference 789: note = a, t, c, g, unknown or other
  misc_difference 790: note = a, t, c, g, unknown or other
  misc_difference 791: note = a, t, c, g, unknown or other
  misc_difference 792: note = a, t, c, g, unknown or other
  misc_difference 793: note = a, t, c, g, unknown or other
  misc_difference 794: note = a, t, c, g, unknown or other
  misc_difference 795: note = a, t, c, g, unknown or other
  misc_difference 796: note = a, t, c, g, unknown or other
  misc_difference 797: note = a, t, c, g, unknown or other
  misc_difference 798: note = a, t, c, g, unknown or other
  misc_difference 799: note = a, t, c, g, unknown or other
  misc_difference 800: note = a, t, c, g, unknown or other
  misc_difference 801: note = a, t, c, g, unknown or other
  misc_difference 802: note = a, t, c, g, unknown or other
  misc_difference 803: note = a, t, c, g, unknown or other
  misc_difference 804: note = a, t, c, g, unknown or other
  misc_difference 805: note = a, t, c, g, unknown or other
  misc_difference 806: note = a, t, c, g, unknown or other
  misc_difference 807: note = a, t, c, g, unknown or other
  misc_difference 808: note = a, t, c, g, unknown or other
  misc_difference 809: note = a, t, c, g, unknown or other
  misc_difference 810: note = a, t, c, g, unknown or other
  misc_difference 811: note = a, t, c, g, unknown or other
  misc_difference 812: note = a, t, c, g, unknown or other
  misc_difference 813: note = a, t, c, g, unknown or other
  misc_difference 814: note = a, t, c, g, unknown or other
  misc_difference 815: note = a, t, c, g, unknown or other
  misc_difference 816: note = a, t, c, g, unknown or other
  misc_difference 817: note = a, t, c, g, unknown or other
  misc_difference 818: note = a, t, c, g, unknown or other
  misc_difference 819: note = a, t, c, g, unknown or other
  misc_difference 820: note = a, t, c, g, unknown or other
  misc_difference 821: note = a, t, c, g, unknown or other
  misc_difference 822: note = a, t, c, g, unknown or other
  misc_difference 823: note = a, t, c, g, unknown or other
  misc_difference 824: note = a, t, c, g, unknown or other
  misc_difference 825: note = a, t, c, g, unknown or other
  misc_difference 826: note = a, t, c, g, unknown or other
  misc_difference 827: note = a, t, c, g, unknown or other
  misc_difference 828: note = a, t, c, g, unknown or other
  misc_difference 829: note = a, t, c, g, unknown or other
  misc_difference 830: note = a, t, c, g, unknown or other
  misc_difference 831: note = a, t, c, g, unknown or other
  misc_difference 832: note = a, t, c, g, unknown or other
  misc_difference 833: note = a, t, c, g, unknown or other
  misc_difference 834: note = a, t, c, g, unknown or other
  misc_difference 835: note = a, t, c, g, unknown or other
  misc_difference 836: note = a, t, c, g, unknown or other
  misc_difference 837: note = a, t, c, g, unknown or other
  misc_difference 838: note = a, t, c, g, unknown or other
  misc_difference 839: note = a, t, c, g, unknown or other
  misc_difference 840: note = a, t, c, g, unknown or other
  misc_difference 841: note = a, t, c, g, unknown or other
  misc_difference 842: note = a, t, c, g, unknown or other
  misc_difference 843: note = a, t, c, g, unknown or other
  misc_difference 844: note = a, t, c, g, unknown or other
  misc_difference 845: note = a, t, c, g, unknown or other
  misc_difference 846: note = a, t, c, g, unknown or other
  misc_difference 847: note = a, t, c, g, unknown or other
  misc_difference 848: note = a, t, c, g, unknown or other
  misc_difference 849: note = a, t, c, g, unknown or other
  misc_difference 850: note = a, t, c, g, unknown or other
  misc_difference 851: note = a, t, c, g, unknown or other
  misc_difference 852: note = a, t, c, g, unknown or other
  misc_difference 853: note = a, t, c, g, unknown or other
  misc_difference 854: note = a, t, c, g, unknown or other
  misc_difference 855: note = a, t, c, g, unknown or other
  misc_difference 856: note = a, t, c, g, unknown or other
  misc_difference 857: note = a, t, c, g, unknown or other
  misc_difference 858: note = a, t, c, g, unknown or other
  misc_difference 859: note = a, t, c, g, unknown or other
  misc_difference 860: note = a, t, c, g, unknown or other
  misc_difference 861: note = a, t, c, g, unknown or other
  misc_difference 862: note = a, t, c, g, unknown or other
  misc_difference 863: note = a, t, c, g, unknown or other
  misc_difference 864: note = a, t, c, g, unknown or other
  misc_difference 865: note = a, t, c, g, unknown or other
  misc_difference 866: note = a, t, c, g, unknown or other
  misc_difference 867: note = a, t, c, g, unknown or other
  misc_difference 868: note = a, t, c, g, unknown or other
  misc_difference 869: note = a, t, c, g, unknown or other
  misc_difference 870: note = a, t, c, g, unknown or other
  misc_difference 871: note = a, t, c, g, unknown or other
  misc_difference 872: note = a, t, c, g, unknown or other
  misc_difference 873: note = a, t, c, g, unknown or other
  misc_difference 874: note = a, t, c, g, unknown or other
  misc_difference 875: note = a, t, c, g, unknown or other
  misc_difference 876: note = a, t, c, g, unknown or other
  misc_difference 877: note = a, t, c, g, unknown or other
  misc_difference 878: note = a, t, c, g, unknown or other
  misc_difference 879: note = a, t, c, g, unknown or other
  misc_difference 880: note = a, t, c, g, unknown or other
  misc_difference 881: note = a, t, c, g, unknown or other
  misc_difference 882: note = a, t, c, g, unknown or other
  misc_difference 883: note = a, t, c, g, unknown or other
  misc_difference 884: note = a, t, c, g, unknown or other
  misc_difference 885: note = a, t, c, g, unknown or other
  misc_difference 886: note = a, t, c, g, unknown or other
  misc_difference 887: note = a, t, c, g, unknown or other
  misc_difference 888: note = a, t, c, g, unknown or other
  misc_difference 889: note = a, t, c, g, unknown or other
  misc_difference 890: note = a, t, c, g, unknown or other
  misc_difference 891: note = a, t, c, g, unknown or other
  misc_difference 892: note = a, t, c, g, unknown or other
  misc_difference 893: note = a, t, c, g, unknown or other
  misc_difference 894: note = a, t, c, g, unknown or other
  misc_difference 895: note = a, t, c, g, unknown or other
  misc_difference 896: note = a, t, c, g, unknown or other
  misc_difference 897: note = a, t, c, g, unknown or other
  misc_difference 898: note = a, t, c, g, unknown or other
  misc_difference 899: note = a, t, c, g, unknown or other
  misc_difference 900: note = a, t, c, g, unknown or other
  misc_difference 901: note = a, t, c, g, unknown or other
  misc_difference 902: note = a, t, c, g, unknown or other
  misc_difference 903: note = a, t, c, g, unknown or other
  misc_difference 904: note = a, t, c, g, unknown or other
  misc_difference 905: note = a, t, c, g, unknown or other
  misc_difference 906: note = a, t, c, g, unknown or other
  misc_difference 907: note = a, t, c, g, unknown or other
  misc_difference 908: note = a, t, c, g, unknown or other
  misc_difference 909: note = a, t, c, g, unknown or other
  misc_difference 910: note = a, t, c, g, unknown or other
  misc_difference 911: note = a, t, c, g, unknown or other
  misc_difference 912: note = a, t, c, g, unknown or other
  misc_difference 913: note = a, t, c, g, unknown or other
  misc_difference 914: note = a, t, c, g, unknown or other
  misc_difference 915: note = a, t, c, g, unknown or other
  misc_difference 916: note = a, t, c, g, unknown or other
  misc_difference 917: note = a, t, c, g, unknown or other
  misc_difference 918: note = a, t, c, g, unknown or other
  misc_difference 919: note = a, t, c, g, unknown or other
  misc_difference 920: note = a, t, c, g, unknown or other
  misc_difference 921: note = a, t, c, g, unknown or other
  misc_difference 922: note = a, t, c, g, unknown or other
  misc_difference 923: note = a, t, c, g, unknown or other
  misc_difference 924: note = a, t, c, g, unknown or other
  misc_difference 925: note = a, t, c, g, unknown or other
  misc_difference 926: note = a, t, c, g, unknown or other
  misc_difference 927: note = a, t, c, g, unknown or other
  misc_difference 928: note = a, t, c, g, unknown or other
  misc_difference 929: note = a, t, c, g, unknown or other
  misc_difference 930: note = a, t, c, g, unknown or other
  misc_difference 931: note = a, t, c, g, unknown or other
  misc_difference 932: note = a, t, c, g, unknown or other
  misc_difference 933: note = a, t, c, g, unknown or other
  misc_difference 934: note = a, t, c, g, unknown or other
  misc_difference 935: note = a, t, c, g, unknown or other
  misc_difference 936: note = a, t, c, g, unknown or other
  misc_difference 937: note = a, t, c, g, unknown or other
  misc_difference 938: note = a, t, c, g, unknown or other
  misc_difference 939: note = a, t, c, g, unknown or other
  misc_difference 940: note = a, t, c, g, unknown or other
  misc_difference 941: note = a, t, c, g, unknown or other
  misc_difference 942: note = a, t, c, g, unknown or other
  misc_difference 943: note = a, t, c, g, unknown or other
  misc_difference 944: note = a, t, c, g, unknown or other
  misc_difference 945: note = a, t, c, g, unknown or other
  misc_difference 946: note = a, t, c, g, unknown or other
  misc_difference 947: note = a, t, c, g, unknown or other
  misc_difference 948: note = a, t, c, g, unknown or other
  misc_difference 949: note = a, t, c, g, unknown or other
  misc_difference 950: note = a, t, c, g, unknown or other
  misc_difference 951: note = a, t, c, g, unknown or other
  misc_difference 952: note = a, t, c, g, unknown or other
  misc_difference 953: note = a, t, c, g, unknown or other
  misc_difference 954: note = a, t, c, g, unknown or other
  misc_difference 955: note = a, t, c, g, unknown or other
  misc_difference 956: note = a, t, c, g, unknown or other
  misc_difference 957: note = a, t, c, g, unknown or other
  misc_difference 958: note = a, t, c, g, unknown or other
  misc_difference 959: note = a, t, c, g, unknown or other
  misc_difference 960: note = a, t, c, g, unknown or other
  misc_difference 961: note = a, t, c, g, unknown or other
  misc_difference 962: note = a, t, c, g, unknown or other
  misc_difference 963: note = a, t, c, g, unknown or other
  misc_difference 964: note = a, t, c, g, unknown or other
  misc_difference 965: note = a, t, c, g, unknown or other
  misc_difference 966: note = a, t, c, g, unknown or other
  misc_difference 967: note = a, t, c, g, unknown or other
  misc_difference 968: note = a, t, c, g, unknown or other
  misc_difference 969: note = a, t, c, g, unknown or other
  misc_difference 970: note = a, t, c, g, unknown or other
  misc_difference 971: note = a, t, c, g, unknown or other
  misc_difference 972: note = a, t, c, g, unknown or other
  misc_difference 973: note = a, t, c, g, unknown or other
  misc_difference 974: note = a, t, c, g, unknown or other
  misc_difference 975: note = a, t, c, g, unknown or other
  misc_difference 976: note = a, t, c, g, unknown or other
  misc_difference 977: note = a, t, c, g, unknown or other
  misc_difference 978: note = a, t, c, g, unknown or other
  misc_difference 979: note = a, t, c, g, unknown or other
  misc_difference 980: note = a, t, c, g, unknown or other
  misc_difference 981: note = a, t, c, g, unknown or other
  misc_difference 982: note = a, t, c, g, unknown or other
  misc_difference 983: note = a, t, c, g, unknown or other
  misc_difference 984: note = a, t, c, g, unknown or other
  misc_difference 985: note = a, t, c, g, unknown or other
  misc_difference 986: note = a, t, c, g, unknown or other
  misc_difference 987: note = a, t, c, g, unknown or other
  misc_difference 988: note = a, t, c, g, unknown or other
  misc_difference 989: note = a, t, c, g, unknown or other
  misc_difference 990: note = a, t, c, g, unknown or other
  misc_difference 991: note = a, t, c, g, unknown or other
  misc_difference 992: note = a, t, c, g, unknown or other
  misc_difference 993: note = a, t, c, g, unknown or other
  misc_difference 994..1008: note = a, t, c, g, unknown or other
  modified_base 1033: mod_base = OTHER; note = hydroxy thymidine
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtactgactgtagggctggcgacct

SEQ ID NO: 8 - DNA, 23 bp, synthetic construct
  source 1..23: mol_type = other DNA
  misc_difference 1: note = a, t, c, g, unknown or other
  misc_difference 2: note = a, t, c, g, unknown or other
  misc_difference 3: note = a, t, c, g, unknown or other
  misc_difference 4: note = a, t, c, g, unknown or other
nnnntcgtcaaggtcgccagccc

SEQ ID NO: 9 - DNA, 1068 bp, synthetic construct
  source 1..1068: mol_type = other DNA
  modified_base 1: mod_base = OTHER; note = Phosphate adenosine
  misc_difference 12: note = a, t, c, g, unknown or other
  misc_difference 13: note = a, t, c, g, unknown or other
  misc_difference 14: note = a, t, c, g, unknown or other
  misc_difference 15: note = a, t, c, g, unknown or other
  misc_difference 16: note = a, t, c, g, unknown or other
  misc_difference 17: note = a, t, c, g, unknown or other
  misc_difference 18: note = a, t, c, g, unknown or other
  misc_difference 19: note = a, t, c, g, unknown or other
  misc_difference 20: note = a, t, c, g, unknown or other
  misc_difference 21: note = a, t, c, g, unknown or other
  misc_difference 22: note = a, t, c, g, unknown or other
  misc_difference 23: note = a, t, c, g, unknown or other
  misc_difference 24: note = a, t, c, g, unknown or other
  misc_difference 25: note = a, t, c, g, unknown or other
  misc_difference 26: note = a, t, c, g, unknown or other
  misc_difference 27: note = a, t, c, g, unknown or other
  misc_difference 28: note = a, t, c, g, unknown or other
  misc_difference 29: note = a, t, c, g, unknown or other
  misc_difference 30: note = a, t, c, g, unknown or other
  misc_difference 31: note = a, t, c, g, unknown or other
  misc_difference 32: note = a, t, c, g, unknown or other
  misc_difference 33: note = a, t, c, g, unknown or other
  misc_difference 34: note = a, t, c, g, unknown or other
  misc_difference 35: note = a, t, c, g, unknown or other
  misc_difference 36: note = a, t, c, g, unknown or other
  misc_difference 37: note = a, t, c, g, unknown or other
  misc_difference 38: note = a, t, c, g, unknown or other
  misc_difference 39: note = a, t, c, g, unknown or other
  misc_difference 40: note = a, t, c, g, unknown or other
  misc_difference 41: note = a, t, c, g, unknown or other
  misc_difference 42: note = a, t, c, g, unknown or other
  misc_difference 43: note = a, t, c, g, unknown or other
  misc_difference 44: note = a, t, c, g, unknown or other
  misc_difference 45: note = a, t, c, g, unknown or other
  misc_difference 46: note = a, t, c, g, unknown or other
  misc_difference 47: note = a, t, c, g, unknown or other
  misc_difference 48: note = a, t, c, g, unknown or other
  misc_difference 49: note = a, t, c, g, unknown or other
  misc_difference 50: note = a, t, c, g, unknown or other
  misc_difference 51: note = a, t, c, g, unknown or other
  misc_difference 52: note = a, t, c, g, unknown or other
  misc_difference 53: note = a, t, c, g, unknown or other
  misc_difference 54: note = a, t, c, g, unknown or other
  misc_difference 55: note = a, t, c, g, unknown or other
  misc_difference 56: note = a, t, c, g, unknown or other
  misc_difference 57: note = a, t, c, g, unknown or other
  misc_difference 58: note = a, t, c, g, unknown or other
  misc_difference 59: note = a, t, c, g, unknown or other
  misc_difference 60: note = a, t, c, g, unknown or other
  misc_difference 61: note = a, t, c, g, unknown or other
  misc_difference 62: note = a, t, c, g, unknown or other
  misc_difference 63: note = a, t, c, g, unknown or other
  misc_difference 64: note = a, t, c, g, unknown or other
  misc_difference 65: note = a, t, c, g, unknown or other
  misc_difference 66: note = a, t, c, g, unknown or other
  misc_difference 67: note = a, t, c, g, unknown or other
  misc_difference 68: note = a, t, c, g, unknown or other
  misc_difference 69: note = a, t, c, g, unknown or other
  misc_difference 70: note = a, t, c, g, unknown or other
  misc_difference 71: note = a, t, c, g, unknown or other
  misc_difference 72: note = a, t, c, g, unknown or other
  misc_difference 73: note = a, t, c, g, unknown or other
  misc_difference 74: note = a, t, c, g, unknown or other
  misc_difference 75: note = a, t, c, g, unknown or other
  misc_difference 76: note = a, t, c, g, unknown or other
  misc_difference 77: note = a, t, c, g, unknown or other
  misc_difference 78: note = a, t, c, g, unknown or other
  misc_difference 79: note = a, t, c, g, unknown or other
  misc_difference 80: note = a, t, c, g, unknown or other
  misc_difference 81: note = a, t, c, g, unknown or other
  misc_difference 82: note = a, t, c, g, unknown or other
  misc_difference 83: note = a, t, c, g, unknown or other
  misc_difference 84: note = a, t, c, g, unknown or other
  misc_difference 85: note = a, t, c, g, unknown or other
  misc_difference 86: note = a, t, c, g, unknown or other
  misc_difference 87: note = a, t, c, g, unknown or other
  misc_difference 88: note = a, t, c, g, unknown or other
  misc_difference 89: note = a, t, c, g, unknown or other
  misc_difference 90: note = a, t, c, g, unknown or other
  misc_difference 91: note = a, t, c, g, unknown or other
  misc_difference 92: note = a, t, c, g, unknown or other
  misc_difference 93: note = a, t, c, g, unknown or other
  misc_difference 94: note = a, t, c, g, unknown or other
  misc_difference 95: note = a, t, c, g, unknown or other
  misc_difference 96: note = a, t, c, g, unknown or other
  misc_difference 97: note = a, t, c, g, unknown or other
  misc_difference 98: note = a, t, c, g, unknown or other
  misc_difference 99: note = a, t, c, g, unknown or other
  misc_difference 100: note = a, t, c, g, unknown or other
  misc_difference 101: note = a, t, c, g, unknown or other
  misc_difference 102: note = a, t, c, g, unknown or other
  misc_difference 103: note = a, t, c, g, unknown or other
  misc_difference 104: note = a, t, c, g, unknown or other
  misc_difference 105: note = a, t, c, g, unknown or other
  misc_difference 106: note = a, t, c, g, unknown or other
  misc_difference 107: note = a, t, c, g, unknown or other
  misc_difference 108: note = a, t, c, g, unknown or other
  misc_difference 109: note = a, t, c, g, unknown or other
  misc_difference 110: note = a, t, c, g, unknown or other
  misc_difference 111: note = a, t, c, g, unknown or other
  misc_difference 112: note = a, t, c, g, unknown or other
  misc_difference 113: note = a, t, c, g, unknown or other
  misc_difference 114: note = a, t, c, g, unknown or other
  misc_difference 115: note = a, t, c, g, unknown or other
  misc_difference 116: note = a, t, c, g, unknown or other
  misc_difference 117: note = a, t, c, g, unknown or other
  misc_difference 118: note = a, t, c, g, unknown or other
  misc_difference 119: note = a, t, c, g, unknown or other
  misc_difference 120: note = a, t, c, g, unknown or other
  misc_difference 121: note = a, t, c, g, unknown or other
  misc_difference 122: note = a, t, c, g, unknown or other
  misc_difference 123: note = a, t, c, g, unknown or other
  misc_difference 124: note = a, t, c, g, unknown or other
  misc_difference 125: note = a, t, c, g, unknown or other
  misc_difference 126: note = a, t, c, g, unknown or other
  misc_difference 127: note = a, t, c, g, unknown or other
  misc_difference 128: note = a, t, c, g, unknown or other
  misc_difference 129: note = a, t, c, g, unknown or other
  misc_difference 130: note = a, t, c, g, unknown or other
  misc_difference 131: note = a, t, c, g, unknown or other
  misc_difference 132: note = a, t, c, g, unknown or other
  misc_difference 133: note = a, t, c, g, unknown or other
  misc_difference 134: note = a, t, c, g, unknown or other
  misc_difference 135: note = a, t, c, g, unknown or other
  misc_difference 136: note = a, t, c, g, unknown or other
  misc_difference 137: note = a, t, c, g, unknown or other
  misc_difference 138: note = a, t, c, g, unknown or other
  misc_difference 139: note = a, t, c, g, unknown or other
  misc_difference 140: note = a, t, c, g, unknown or other
  misc_difference 141: note = a, t, c, g, unknown or other
  misc_difference 142: note = a, t, c, g, unknown or other
  misc_difference 143: note = a, t, c, g, unknown or other
  misc_difference 144: note = a, t, c, g, unknown or other
  misc_difference 145: note = a, t, c, g, unknown or other
  misc_difference 146: note = a, t, c, g, unknown or other
  misc_difference 147: note = a, t, c, g, unknown or other
  misc_difference 148: note = a, t, c, g, unknown or other
  misc_difference 149: note = a, t, c, g, unknown or other
  misc_difference 150: note = a, t, c, g, unknown or other
  misc_difference 151: note = a, t, c, g, unknown or other
  misc_difference 152: note = a, t, c, g, unknown or other
  misc_difference 153: note = a, t, c, g, unknown or other
  misc_difference 154: note = a, t, c, g, unknown or other
  misc_difference 155: note = a, t, c, g, unknown or other
  misc_difference 156: note = a, t, c, g, unknown or other
  misc_difference 157: note = a, t, c, g, unknown or other
  misc_difference 158: note = a, t, c, g, unknown or other
  misc_difference 159: note = a, t, c, g, unknown or other
  misc_difference 160: note = a, t, c, g, unknown or other
  misc_difference 161: note = a, t, c, g, unknown or other
  misc_difference 162: note = a, t, c, g, unknown or other
  misc_difference 163: note = a, t, c, g, unknown or other
  misc_difference 164: note = a, t, c, g, unknown or other
  misc_difference 165: note = a, t, c, g, unknown or other
  misc_difference 166: note = a, t, c, g, unknown or other
  misc_difference 167: note = a, t, c, g, unknown or other
  misc_difference 168: note = a, t, c, g, unknown or other
  misc_difference 169: note = a, t, c, g, unknown or other
  misc_difference 170: note = a, t, c, g, unknown or other
  misc_difference 171: note = a, t, c, g, unknown or other
  misc_difference 172: note = a, t, c, g, unknown or other
  misc_difference 173: note = a, t, c, g, unknown or other
  misc_difference 174: note = a, t, c, g, unknown or other
  misc_difference 175: note = a, t, c, g, unknown or other
  misc_difference 176: note = a, t, c, g, unknown or other
  misc_difference 177: note = a, t, c, g, unknown or other
  misc_difference 178: note = a, t, c, g, unknown or other
  misc_difference 179: note = a, t, c, g, unknown or other
  misc_difference 180: note = a, t, c, g, unknown or other
  misc_difference 181: note = a, t, c, g, unknown or other
  misc_difference 182: note = a, t, c, g, unknown or other
  misc_difference 183: note = a, t, c, g, unknown or other
  misc_difference 184: note = a, t, c, g, unknown or other
  misc_difference 185: note = a, t, c, g, unknown or other
  misc_difference 186: note = a, t, c, g, unknown or other
  misc_difference 187: note = a, t, c, g, unknown or other
  misc_difference 188: note = a, t, c, g, unknown or other
  misc_difference 189: note = a, t, c, g, unknown or other
  misc_difference 190: note = a, t, c, g, unknown or other
  misc_difference 191: note = a, t, c, g, unknown or other
  misc_difference 192: note = a, t, c, g, unknown or other
  misc_difference 193: note = a, t, c, g, unknown or other
  misc_difference 194: note = a, t, c, g, unknown or other
  misc_difference 195: note = a, t, c, g, unknown or other
  misc_difference 196: note = a, t, c, g, unknown or other
  misc_difference 197: note = a, t, c, g, unknown or other
  misc_difference 198: note = a, t, c, g, unknown or other
  misc_difference 199: note = a, t, c, g, unknown or other
  misc_difference 200: note = a, t, c, g, unknown or other
  misc_difference 201: note = a, t, c, g, unknown or other
  misc_difference 202: note = a, t, c, g, unknown or other
  misc_difference 203: note = a, t, c, g, unknown or other
  misc_difference 204: note = a, t, c, g, unknown or other
  misc_difference 205: note = a, t, c, g, unknown or other
  misc_difference 206: note = a, t, c, g, unknown or other
  misc_difference 207: note = a, t, c, g, unknown or other
  misc_difference 208: note = a, t, c, g, unknown or other
  misc_difference 209: note = a, t, c, g, unknown or other
  misc_difference 210: note = a, t, c, g, unknown or other
  misc_difference 211: note = a, t, c, g, unknown or other
  misc_difference 212: note = a, t, c, g, unknown or other
  misc_difference 213: note = a, t, c, g, unknown or other
  misc_difference 214: note = a, t, c, g, unknown or other
  misc_difference 215: note = a, t, c, g, unknown or other
  misc_difference 216: note = a, t, c, g, unknown or other
  misc_difference 217: note = a, t, c, g, unknown or other
  misc_difference 218: note = a, t, c, g, unknown or other
  misc_difference 219: note = a, t, c, g, unknown or other
  misc_difference 220: note = a, t, c, g, unknown or other
  misc_difference 221: note = a, t, c, g, unknown or other
  misc_difference 222: note = a, t, c, g, unknown or other
  misc_difference 223: note = a, t, c, g, unknown or other
  misc_difference 224: note = a, t, c, g, unknown or other
  misc_difference 225: note = a, t, c, g, unknown or other
  misc_difference 226: note = a, t, c, g, unknown or other
  misc_difference 227: note = a, t, c, g, unknown or other
  misc_difference 228: note = a, t, c, g, unknown or other
  misc_difference 229: note = a, t, c, g, unknown or other
  misc_difference 230: note = a, t, c, g, unknown or other
  misc_difference 231: note = a, t, c, g, unknown or other
  misc_difference 232: note = a, t, c, g, unknown or other
  misc_difference 233: note = a, t, c, g, unknown or other
  misc_difference 234: note = a, t, c, g, unknown or other
  misc_difference 235: note = a, t, c, g, unknown or other
  misc_difference 236: note = a, t, c, g, unknown or other
  misc_difference 237: note = a, t, c, g, unknown or other
  misc_difference 238: note = a, t, c, g, unknown or other
  misc_difference 239: note = a, t, c, g, unknown or other
  misc_difference 240: note = a, t, c, g, unknown or other
  misc_difference 241: note = a, t, c, g, unknown or other
  misc_difference 242: note = a, t, c, g, unknown or other
  misc_difference 243: note = a, t, c, g, unknown or other
  misc_difference 244: note = a, t, c, g, unknown or other
  misc_difference 245: note = a, t, c, g, unknown or other
  misc_difference 246: note = a, t, c, g, unknown or other
  misc_difference 247: note = a, t, c, g, unknown or other
  misc_difference 248: note = a, t, c, g, unknown or other
  misc_difference 249: note = a, t, c, g, unknown or other
  misc_difference 250: note = a, t, c, g, unknown or other
  misc_difference 251: note = a, t, c, g, unknown or other
  misc_difference 252: note = a, t, c, g, unknown or other
  misc_difference 253: note = a, t, c, g, unknown or other
  misc_difference 254: note = a, t, c, g, unknown or other
  misc_difference 255: note = a, t, c, g, unknown or other
  misc_difference 256: note = a, t, c, g, unknown or other
  misc_difference 257: note = a, t, c, g, unknown or other
  misc_difference 258: note = a, t, c, g, unknown or other
  misc_difference 259: note = a, t, c, g, unknown or other
  misc_difference 260: note = a, t, c, g, unknown or other
  misc_difference 261: note = a, t, c, g, unknown or other
  misc_difference 262: note = a, t, c, g, unknown or other
  misc_difference 263: note = a, t, c, g, unknown or other
  misc_difference 264: note = a, t, c, g, unknown or other
  misc_difference 265: note = a, t, c, g, unknown or other
  misc_difference 266: note = a, t, c, g, unknown or other
  misc_difference 267: note = a, t, c, g, unknown or other
  misc_difference 268: note = a, t, c, g, unknown or other
  misc_difference 269: note = a, t, c, g, unknown or other
  misc_difference 270: note = a, t, c, g, unknown or other
  misc_difference 271: note = a, t, c, g, unknown or other
  misc_difference 272: note = a, t, c, g, unknown or other
  misc_difference 273: note = a, t, c, g, unknown or other
  misc_difference 274: note = a, t, c, g, unknown or other
  misc_difference 275: note = a, t, c, g, unknown or other
  misc_difference 276: note = a, t, c, g, unknown or other
  misc_difference 277: note = a, t, c, g, unknown or other
  misc_difference 278: note = a, t, c, g, unknown or other
  misc_difference 279: note = a, t, c, g, unknown or other
  misc_difference 280: note = a, t, c, g, unknown or other
  misc_difference 281: note = a, t, c, g, unknown or other
  misc_difference 282: note = a, t, c, g, unknown or other
  misc_difference 283: note = a, t, c, g, unknown or other
  misc_difference 284: note = a, t, c, g, unknown or other
  misc_difference 285: note = a, t, c, g, unknown or other
  misc_difference 286: note = a, t, c, g, unknown or other
  misc_difference 287: note = a, t, c, g, unknown or other
  misc_difference 288: note = a, t, c, g, unknown or other
  misc_difference 289: note = a, t, c, g, unknown or other
  misc_difference 290: note = a, t, c, g, unknown or other
  misc_difference 291: note = a, t, c, g, unknown or other
  misc_difference 292: note = a, t, c, g, unknown or other
  misc_difference 293: note = a, t, c, g, unknown or other
  misc_difference 294: note = a, t, c, g, unknown or other
  misc_difference 295: note = a, t, c, g, unknown or other
  misc_difference 296: note = a, t, c, g, unknown or other
  misc_difference 297: note = a, t, c, g, unknown or other
  misc_difference 298: note = a, t, c, g, unknown or other
  misc_difference 299: note = a, t, c, g, unknown or other
  misc_difference 300: note = a, t, c, g, unknown or other
  misc_difference 301: note = a, t, c, g, unknown or other
  misc_difference 302: note = a, t, c, g, unknown or other
  misc_difference 303: note = a, t, c, g, unknown or other
  misc_difference 304: note = a, t, c, g, unknown or other
  misc_difference 305: note = a, t, c, g, unknown or other
  misc_difference 306: note = a, t, c, g, unknown or other
  misc_difference 307: note = a, t, c, g, unknown or other
  misc_difference 308: note = a, t, c, g, unknown or other
  misc_difference 309: note = a, t, c, g, unknown or other
  misc_difference 310: note = a, t, c, g, unknown or other
  misc_difference 311: note = a, t, c, g, unknown or other
  misc_difference 312: note = a, t, c, g, unknown or other
  misc_difference 313: note = a, t, c, g, unknown or other
  misc_difference 314: note = a, t, c, g, unknown or other
  misc_difference 315: note = a, t, c, g, unknown or other
  misc_difference 316: note = a, t, c, g, unknown or other
  misc_difference 317: note = a, t, c, g, unknown or other
  misc_difference 318: note = a, t, c, g, unknown or other
  misc_difference 319: note = a, t, c, g, unknown or other
  misc_difference 320: note = a, t, c, g, unknown or other
  misc_difference 321: note = a, t, c, g, unknown or other
  misc_difference 322: note = a, t, c, g, unknown or other
  misc_difference 323: note = a, t, c, g, unknown or other
  misc_difference 324: note = a, t, c, g, unknown or other
  misc_difference 325: note = a, t, c, g, unknown or other
  misc_difference 326: note = a, t, c, g, unknown or other
  misc_difference 327: note = a, t, c, g, unknown or other
  misc_difference 328: note = a, t, c, g, unknown or other
  misc_difference 329: note = a, t, c, g, unknown or other
  misc_difference 330: note = a, t, c, g, unknown or other
  misc_difference 331: note = a, t, c, g, unknown or other
  misc_difference 332: note = a, t, c, g, unknown or other
  misc_difference 333: note = a, t, c, g, unknown or other
  misc_difference 334: note = a, t, c, g, unknown or other
  misc_difference 335: note = a, t, c, g, unknown or other
  misc_difference 336: note = a, t, c, g, unknown or other
  misc_difference 337: note = a, t, c, g, unknown or other
  misc_difference 338: note = a, t, c, g, unknown or other
  misc_difference 339: note = a, t, c, g, unknown or other
  misc_difference 340: note = a, t, c, g, unknown or other
  misc_difference 341: note = a, t, c, g, unknown or other
  misc_difference 342: note = a, t, c, g, unknown or other
  misc_difference 343: note = a, t, c, g, unknown or other
  misc_difference 344: note = a, t, c, g, unknown or other
  misc_difference 345: note = a, t, c, g, unknown or other
  misc_difference 346: note = a, t, c, g, unknown or other
  misc_difference 347: note = a, t, c, g, unknown or other
  misc_difference 348: note = a, t, c, g, unknown or other
  misc_difference 349: note = a, t, c, g, unknown or other
  misc_difference 350: note = a, t, c, g, unknown or other
  misc_difference 351: note = a, t, c, g, unknown or other
  misc_difference 352: note = a, t, c, g, unknown or other
  misc_difference 353: note = a, t, c, g, unknown or other
  misc_difference 354: note = a, t, c, g, unknown or other
  misc_difference 355: note = a, t, c, g, unknown or other
  misc_difference 356: note = a, t, c, g, unknown or other
  misc_difference 357: note = a, t, c, g, unknown or other
  misc_difference 358: note = a, t, c, g, unknown or other
  misc_difference 359: note = a, t, c, g, unknown or other
  misc_difference 360: note = a, t, c, g, unknown or other
  misc_difference 361: note = a, t, c, g, unknown or other
  misc_difference 362: note = a, t, c, g, unknown or other
  misc_difference 363: note = a, t, c, g, unknown or other
  misc_difference 364: note = a, t, c, g, unknown or other
  misc_difference 365: note = a, t, c, g, unknown or other
  misc_difference 366: note = a, t, c, g, unknown or other
  misc_difference 367: note = a, t, c, g, unknown or other
  misc_difference 368: note = a, t, c, g, unknown or other
  misc_difference 369: note = a, t, c, g, unknown or other
  misc_difference 370: note = a, t, c, g, unknown or other
  misc_difference 371: note = a, t, c, g, unknown or other
  misc_difference 372: note = a, t, c, g, unknown or other
  misc_difference 373: note = a, t, c, g, unknown or other
  misc_difference 374: note = a, t, c, g, unknown or other
  misc_difference 375: note = a, t, c, g, unknown or other
  misc_difference 376: note = a, t, c, g, unknown or other
  misc_difference 377: note = a, t, c, g, unknown or other
  misc_difference 378: note = a, t, c, g, unknown or other
  misc_difference 379: note = a, t, c, g, unknown or other
  misc_difference 380: note = a, t, c, g, unknown or other
  misc_difference 381: note = a, t, c, g, unknown or other
  misc_difference 382: note = a, t, c, g, unknown or other
  misc_difference 383: note = a, t, c, g, unknown or other
  misc_difference 384: note = a, t, c, g, unknown or other
  misc_difference 385: note = a, t, c, g, unknown or other
  misc_difference 386: note = a, t, c, g, unknown or other
  misc_difference 387: note = a, t, c, g, unknown or other
  misc_difference 388: note = a, t, c, g, unknown or other
  misc_difference 389: note = a, t, c, g, unknown or other
  misc_difference 390: note = a, t, c, g, unknown or other
  misc_difference 391: note = a, t, c, g, unknown or other
  misc_difference 392: note = a, t, c, g, unknown or other
  misc_difference 393: note = a, t, c, g, unknown or other
  misc_difference 394: note = a, t, c, g, unknown or other
  misc_difference 395: note = a, t, c, g, unknown or other
  misc_difference 396: note = a, t, c, g, unknown or other
  misc_difference 397: note = a, t, c, g, unknown or other
  misc_difference 398: note = a, t, c, g, unknown or other
  misc_difference 399: note = a, t, c, g, unknown or other
  misc_difference 400: note = a, t, c, g, unknown or other
  misc_difference 401: note = a, t, c, g, unknown or other
  misc_difference 402: note = a, t, c, g, unknown or other
  misc_difference 403: note = a, t, c, g, unknown or other
  misc_difference 404: note = a, t, c, g, unknown or other
  misc_difference 405: note = a, t, c, g, unknown or other
  misc_difference 406: note = a, t, c, g, unknown or other
  misc_difference 407: note = a, t, c, g, unknown or other
  misc_difference 408: note = a, t, c, g, unknown or other
  misc_difference 409: note = a, t, c, g, unknown or other
  misc_difference 410: note = a, t, c, g, unknown or other
  misc_difference 411: note = a, t, c, g, unknown or other
  misc_difference 412: note = a, t, c, g, unknown or other
  misc_difference 413: note = a, t, c, g, unknown or other
  misc_difference 414: note = a, t, c, g, unknown or other
  misc_difference 415: note = a, t, c, g, unknown or other
  misc_difference 416: note = a, t, c, g, unknown or other
  misc_difference 417: note = a, t, c, g, unknown or other
  misc_difference 418: note = a, t, c, g, unknown or other
  misc_difference 419: note = a, t, c, g, unknown or other
  misc_difference 420: note = a, t, c, g, unknown or other
  misc_difference 421: note = a, t, c, g, unknown or other
  misc_difference 422: note = a, t, c, g, unknown or other
  misc_difference 423: note = a, t, c, g, unknown or other
  misc_difference 424: note = a, t, c, g, unknown or other
  misc_difference 425: note = a, t, c, g, unknown or other
  misc_difference 426: note = a, t, c, g, unknown or other
  misc_difference 427: note = a, t, c, g, unknown or other
  misc_difference 428: note = a, t, c, g, unknown or other
  misc_difference 429: note = a, t, c, g, unknown or other
  misc_difference 430: note = a, t, c, g, unknown or other
  misc_difference 431: note = a, t, c, g, unknown or other
  misc_difference 432: note = a, t, c, g, unknown or other
  misc_difference 433: note = a, t, c, g, unknown or other
  misc_difference 434: note = a, t, c, g, unknown or other
  misc_difference 435: note = a, t, c, g, unknown or other
  misc_difference 436: note = a, t, c, g, unknown or other
  misc_difference 437: note = a, t, c, g, unknown or other
  misc_difference 438: note = a, t, c, g, unknown or other
  misc_difference 439: note = a, t, c, g, unknown or other
  misc_difference 440: note = a, t, c, g, unknown or other
  misc_difference 441: note = a, t, c, g, unknown or other
  misc_difference 442: note = a, t, c, g, unknown or other
  misc_difference 443: note = a, t, c, g, unknown or other
  misc_difference 444: note = a, t, c, g, unknown or other
  misc_difference 445: note = a, t, c, g, unknown or other
  misc_difference 446: note = a, t, c, g, unknown or other
  misc_difference 447: note = a, t, c, g, unknown or other
  misc_difference 448: note = a, t, c, g, unknown or other
  misc_difference 449: note = a, t, c, g, unknown or other
  misc_difference 450: note = a, t, c, g, unknown or other
  misc_difference 451: note = a, t, c, g, unknown or other
  misc_difference 452: note = a, t, c, g, unknown or other
  misc_difference 453: note = a, t, c, g, unknown or other
  misc_difference 454: note = a, t, c, g, unknown or other
  misc_difference 455: note = a, t, c, g, unknown or other
  misc_difference 456: note = a, t, c, g, unknown or other
  misc_difference 457: note = a, t, c, g, unknown or other
  misc_difference 458: note = a, t, c, g, unknown or other
  misc_difference 459: note = a, t, c, g, unknown or other
  misc_difference 460: note = a, t, c, g, unknown or other
  misc_difference 461: note = a, t, c, g, unknown or other
  misc_difference 462: note = a, t, c, g, unknown or other
  misc_difference 463: note = a, t, c, g, unknown or other
  misc_difference 464: note = a, t, c, g, unknown or other
  misc_difference 465: note = a, t, c, g, unknown or other
  misc_difference 466: note = a, t, c, g, unknown or other
  misc_difference 467: note = a, t, c, g, unknown or other
  misc_difference 468: note = a, t, c, g, unknown or other
  misc_difference 469: note = a, t, c, g, unknown or other
  misc_difference 470: note = a, t, c, g, unknown or other
  misc_difference 471: note = a, t, c, g, unknown or other
  misc_difference 472: note = a, t, c, g, unknown or other
  misc_difference 473: note = a, t, c, g, unknown or other
  misc_difference 474: note = a, t, c, g, unknown or other
  misc_difference 475: note = a, t, c, g, unknown or other
  misc_difference 476: note = a, t, c, g, unknown or other
  misc_difference 477: note = a, t, c, g, unknown or other
  misc_difference 478: note = a, t, c, g, unknown or other
  misc_difference 479: note = a, t, c, g, unknown or other
  misc_difference 480: note = a, t, c, g, unknown or other
  misc_difference 481: note = a, t, c, g, unknown or other
  misc_difference 482: note = a, t, c, g, unknown or other
  misc_difference 483: note = a, t, c, g, unknown or other
  misc_difference 484: note = a, t, c, g, unknown or other
  misc_difference 485: note = a, t, c, g, unknown or other
  misc_difference 486: note = a, t, c, g, unknown or other
  misc_difference 487: note = a, t, c, g, unknown or other
  misc_difference 488: note = a, t, c, g, unknown or other
  misc_difference 489: note = a, t, c, g, unknown or other
  misc_difference 490: note = a, t, c, g, unknown or other
  misc_difference 491: note = a, t, c, g, unknown or other
  misc_difference 492: note = a, t, c, g, unknown or other
  misc_difference 493: note = a, t, c, g, unknown or other
  misc_difference 494: note = a, t, c, g, unknown or other
  misc_difference 495: note = a, t, c, g, unknown or other
  misc_difference 496: note = a, t, c, g, unknown or other
  misc_difference 497: note = a, t, c, g, unknown or other
  misc_difference 498: note = a, t, c, g, unknown or other
  misc_difference 499: note = a, t, c, g, unknown or other
  misc_difference 500: note = a, t, c, g, unknown or other
  misc_difference 501: note = a, t, c, g, unknown or other
  misc_difference 502: note = a, t, c, g, unknown or other
  misc_difference 503: note = a, t, c, g, unknown or other
  misc_difference 504: note = a, t, c, g, unknown or other
  misc_difference 505: note = a, t, c, g, unknown or other
  misc_difference 506: note = a, t, c, g, unknown or other
  misc_difference 507: note = a, t, c, g, unknown or other
  misc_difference 508: note = a, t, c, g, unknown or other
  misc_difference 509: note = a, t, c, g, unknown or other
  misc_difference 510: note = a, t, c, g, unknown or other
  misc_difference 511: note = a, t, c, g, unknown or other
  misc_difference 512: note = a, t, c, g, unknown or other
  misc_difference 513: note = a, t, c, g, unknown or other
  misc_difference 514: note = a, t, c, g, unknown or other
  misc_difference 515: note = a, t, c, g, unknown or other
  misc_difference 516: note = a, t, c, g, unknown or other
  misc_difference 517: note = a, t, c, g, unknown or other
  misc_difference 518: note = a, t, c, g, unknown or other
  misc_difference 519: note = a, t, c, g, unknown or other
  misc_difference 520: note = a, t, c, g, unknown or other
  misc_difference 521: note = a, t, c, g, unknown or other
  misc_difference 522: note = a, t, c, g, unknown or other
  misc_difference 523: note = a, t, c, g, unknown or other
  misc_difference 524: note = a, t, c, g, unknown or other
  misc_difference 525: note = a, t, c, g, unknown or other
  misc_difference 526: note = a, t, c, g, unknown or other
  misc_difference 527: note = a, t, c, g, unknown or other
  misc_difference 528: note = a, t, c, g, unknown or other
  misc_difference 529: note = a, t, c, g, unknown or other
  misc_difference 530: note = a, t, c, g, unknown or other
  misc_difference 531: note = a, t, c, g, unknown or other
  misc_difference 532: note = a, t, c, g, unknown or other
  misc_difference 533: note = a, t, c, g, unknown or other
  misc_difference 534: note = a, t, c, g, unknown or other
  misc_difference 535: note = a, t, c, g, unknown or other
  misc_difference 536: note = a, t, c, g, unknown or other
  misc_difference 537: note = a, t, c, g, unknown or other
  misc_difference 538: note = a, t, c, g, unknown or other
  misc_difference 539: note = a, t, c, g, unknown or other
  misc_difference 540: note = a, t, c, g, unknown or other
  misc_difference 541: note = a, t, c, g, unknown or other
  misc_difference 542: note = a, t, c, g, unknown or other
  misc_difference 543: note = a, t, c, g, unknown or other
  misc_difference 544: note = a, t, c, g, unknown or other
  misc_difference 545: note = a, t, c, g, unknown or other
  misc_difference 546: note = a, t, c, g, unknown or other
  misc_difference 547: note = a, t, c, g, unknown or other
  misc_difference 548: note = a, t, c, g, unknown or other
  misc_difference 549: note = a, t, c, g, unknown or other
  misc_difference 550: note = a, t, c, g, unknown or other
  misc_difference 551: note = a, t, c, g, unknown or other
  misc_difference 552: note = a, t, c, g, unknown or other
  misc_difference 553: note = a, t, c, g, unknown or other
  misc_difference 554: note = a, t, c, g, unknown or other
  misc_difference 555: note = a, t, c, g, unknown or other
  misc_difference 556: note = a, t, c, g, unknown or other
  misc_difference 557: note = a, t, c, g, unknown or other
  misc_difference 558: note = a, t, c, g, unknown or other
  misc_difference 559: note = a, t, c, g, unknown or other
  misc_difference 560: note = a, t, c, g, unknown or other
  misc_difference 561: note = a, t, c, g, unknown or other
  misc_difference 562: note = a, t, c, g, unknown or other
  misc_difference 563: note = a, t, c, g, unknown or other
  misc_difference 564: note = a, t, c, g, unknown or other
  misc_difference 565: note = a, t, c, g, unknown or other
  misc_difference 566: note = a, t, c, g, unknown or other
  misc_difference 567: note = a, t, c, g, unknown or other
  misc_difference 568: note = a, t, c, g, unknown or other
  misc_difference 569: note = a, t, c, g, unknown or other
  misc_difference 570: note = a, t, c, g, unknown or other
  misc_difference 571: note = a, t, c, g, unknown or other
  misc_difference 572: note = a, t, c, g, unknown or other
  misc_difference 573: note = a, t, c, g, unknown or other
  misc_difference 574: note = a, t, c, g, unknown or other
  misc_difference 575: note = a, t, c, g, unknown or other
  misc_difference 576: note = a, t, c, g, unknown or other
  misc_difference 577: note = a, t, c, g, unknown or other
  misc_difference 578: note = a, t, c, g, unknown or other
  misc_difference 579: note = a, t, c, g, unknown or other
  misc_difference 580: note = a, t, c, g, unknown or other
  misc_difference 581: note = a, t, c, g, unknown or other
  misc_difference 582: note = a, t, c, g, unknown or other
  misc_difference 583: note = a, t, c, g, unknown or other
  misc_difference 584: note = a, t, c, g, unknown or other
  misc_difference 585: note = a, t, c, g, unknown or other
  misc_difference 586: note = a, t, c, g, unknown or other
  misc_difference 587: note = a, t, c, g, unknown or other
  misc_difference 588: note = a, t, c, g, unknown or other
  misc_difference 589: note = a, t, c, g, unknown or other
  misc_difference 590: note = a, t, c, g, unknown or other
  misc_difference 591: note = a, t, c, g, unknown or other
  misc_difference 592: note = a, t, c, g, unknown or other
  misc_difference 593: note = a, t, c, g, unknown or other
  misc_difference 594: note = a, t, c, g, unknown or other
  misc_difference 595: note = a, t, c, g, unknown or other
  misc_difference 596: note = a, t, c, g, unknown or other
  misc_difference 597: note = a, t, c, g, unknown or other
  misc_difference 598: note = a, t, c, g, unknown or other
  misc_difference 599: note = a, t, c, g, unknown or other
  misc_difference 600: note = a, t, c, g, unknown or other
  misc_difference 601: note = a, t, c, g, unknown or other
  misc_difference 602: note = a, t, c, g, unknown or other
  misc_difference 603: note = a, t, c, g, unknown or other
  misc_difference 604: note = a, t, c, g, unknown or other
  misc_difference 605: note = a, t, c, g, unknown or other
  misc_difference 606: note = a, t, c, g, unknown or other
  misc_difference 607: note = a, t, c, g, unknown or other
  misc_difference 608: note = a, t, c, g, unknown or other
  misc_difference 609: note = a, t, c, g, unknown or other
  misc_difference 610: note = a, t, c, g, unknown or other
  misc_difference 611: note = a, t, c, g, unknown or other
  misc_difference 612: note = a, t, c, g, unknown or other
  misc_difference 613: note = a, t, c, g, unknown or other
  misc_difference 614: note = a, t, c, g, unknown or other
  misc_difference 615: note = a, t, c, g, unknown or other
  misc_difference 616: note = a, t, c, g, unknown or other
  misc_difference 617: note = a, t, c, g, unknown or other
  misc_difference 618: note = a, t, c, g, unknown or other
  misc_difference 619: note = a, t, c, g, unknown or other
  misc_difference 620: note = a, t, c, g, unknown or other
  misc_difference 621: note = a, t, c, g, unknown or other
  misc_difference 622: note = a, t, c, g, unknown or other
  misc_difference 623: note = a, t, c, g, unknown or other
  misc_difference 624: note = a, t, c, g, unknown or other
  misc_difference 625: note = a, t, c, g, unknown or other
  misc_difference 626: note = a, t, c, g, unknown or other
  misc_difference 627: note = a, t, c, g, unknown or other
  misc_difference 628: note = a, t, c, g, unknown or other
  misc_difference 629: note = a, t, c, g, unknown or other
  misc_difference 630: note = a, t, c, g, unknown or other
  misc_difference 631: note = a, t, c, g, unknown or other
  misc_difference 632: note = a, t, c, g, unknown or other
  misc_difference 633: note = a, t, c, g, unknown or other
  misc_difference 634: note = a, t, c, g, unknown or other
  misc_difference 635: note = a, t, c, g, unknown or other
  misc_difference 636: note = a, t, c, g, unknown or other
  misc_difference 637: note = a, t, c, g, unknown or other
  misc_difference 638: note = a, t, c, g, unknown or other
  misc_difference 639: note = a, t, c, g, unknown or other
  misc_difference 640: note = a, t, c, g, unknown or other
  misc_difference 641: note = a, t, c, g, unknown or other
  misc_difference 642: note = a, t, c, g, unknown or other
  misc_difference 643: note = a, t, c, g, unknown or other
  misc_difference 644: note = a, t, c, g, unknown or other
  misc_difference 645: note = a, t, c, g, unknown or other
  misc_difference 646: note = a, t, c, g, unknown or other
  misc_difference 647: note = a, t, c, g, unknown or other
  misc_difference 648: note = a, t, c, g, unknown or other
  misc_difference 649: note = a, t, c, g, unknown or other
  misc_difference 650: note = a, t, c, g, unknown or other
  misc_difference 651: note = a, t, c, g, unknown or other
  misc_difference 652: note = a, t, c, g, unknown or other
  misc_difference 653: note = a, t, c, g, unknown or other
  misc_difference 654: note = a, t, c, g, unknown or other
  misc_difference 655: note = a, t, c, g, unknown or other
  misc_difference 656: note = a, t, c, g, unknown or other
  misc_difference 657: note = a, t, c, g, unknown or other
  misc_difference 658: note = a, t, c, g, unknown or other
  misc_difference 659: note = a, t, c, g, unknown or other
  misc_difference 660: note = a, t, c, g, unknown or other
  misc_difference 661: note = a, t, c, g, unknown or other
  misc_difference 662: note = a, t, c, g, unknown or other
  misc_difference 663: note = a, t, c, g, unknown or other
  misc_difference 664: note = a, t, c, g, unknown or other
  misc_difference 665: note = a, t, c, g, unknown or other
  misc_difference 666: note = a, t, c, g, unknown or other
  misc_difference 667: note = a, t, c, g, unknown or other
  misc_difference 668: note = a, t, c, g, unknown or other
  misc_difference 669: note = a, t, c, g, unknown or other
  misc_difference 670: note = a, t, c, g, unknown or other
  misc_difference 671: note = a, t, c, g, unknown or other
  misc_difference 672: note = a, t, c, g, unknown or other
  misc_difference 673: note = a, t, c, g, unknown or other
  misc_difference 674: note = a, t, c, g, unknown or other
  misc_difference 675: note = a, t, c, g, unknown or other
  misc_difference 676: note = a, t, c, g, unknown or other
  misc_difference 677: note = a, t, c, g, unknown or other
  misc_difference 678: note = a, t, c, g, unknown or other
  misc_difference 679: note = a, t, c, g, unknown or other
  misc_difference 680: note = a, t, c, g, unknown or other
  misc_difference 681: note = a, t, c, g, unknown or other
  misc_difference 682: note = a, t, c, g, unknown or other
  misc_difference 683: note = a, t, c, g, unknown or other
  misc_difference 684: note = a, t, c, g, unknown or other
  misc_difference 685: note = a, t, c, g, unknown or other
  misc_difference 686: note = a, t, c, g, unknown or other
  misc_difference 687: note = a, t, c, g, unknown or other
  misc_difference 688: note = a, t, c, g, unknown or other
  misc_difference 689: note = a, t, c, g, unknown or other
  misc_difference 690: note = a, t, c, g, unknown or other
  misc_difference 691: note = a, t, c, g, unknown or other
  misc_difference 692: note = a, t, c, g, unknown or other
  misc_difference 693: note = a, t, c, g, unknown or other
  misc_difference 694: note = a, t, c, g, unknown or other
  misc_difference 695: note = a, t, c, g, unknown or other
  misc_difference 696: note = a, t, c, g, unknown or other
  misc_difference 697: note = a, t, c, g, unknown or other
  misc_difference 698: note = a, t, c, g, unknown or other
  misc_difference 699: note = a, t, c, g, unknown or other
  misc_difference 700: note = a, t, c, g, unknown or other
  misc_difference 701: note = a, t, c, g, unknown or other
  misc_difference 702: note = a, t, c, g, unknown or other
  misc_difference 703: note = a, t, c, g, unknown or other
  misc_difference 704: note = a, t, c, g, unknown or other
  misc_difference 705: note = a, t, c, g, unknown or other
  misc_difference 706: note = a, t, c, g, unknown or other
  misc_difference 707: note = a, t, c, g, unknown or other
  misc_difference 708: note = a, t, c, g, unknown or other
  misc_difference 709: note = a, t, c, g, unknown or other
  misc_difference 710: note = a, t, c, g, unknown or other
  misc_difference 711: note = a, t, c, g, unknown or other
  misc_difference 712: note = a, t, c, g, unknown or other
  misc_difference 713: note = a, t, c, g, unknown or other
  misc_difference 714: note = a, t, c, g, unknown or other
  misc_difference 715: note = a, t, c, g, unknown or other
  misc_difference 716: note = a, t, c, g, unknown or other
  misc_difference 717: note = a, t, c, g, unknown or other
  misc_difference 718: note = a, t, c, g, unknown or other
  misc_difference 719: note = a, t, c, g, unknown or other
  misc_difference 720: note = a, t, c, g, unknown or other
  misc_difference 721: note = a, t, c, g, unknown or other
  misc_difference 722: note = a, t, c, g, unknown or other
  misc_difference 723: note = a, t, c, g, unknown or other
  misc_difference 724: note = a, t, c, g, unknown or other
  misc_difference 725: note = a, t, c, g, unknown or other
  misc_difference 726: note = a, t, c, g, unknown or other
  misc_difference 727: note = a, t, c, g, unknown or other
  misc_difference 728: note = a, t, c, g, unknown or other
  misc_difference 729: note = a, t, c, g, unknown or other
  misc_difference 730: note = a, t, c, g, unknown or other
  misc_difference 731: note = a, t, c, g, unknown or other
  misc_difference 732: note = a, t, c, g, unknown or other
  misc_difference 733: note = a, t, c, g, unknown or other
  misc_difference 734: note = a, t, c, g, unknown or other
  misc_difference 735: note = a, t, c, g, unknown or other
  misc_difference 736: note = a, t, c, g, unknown or other
  misc_difference 737: note = a, t, c, g, unknown or other
  misc_difference 738: note = a, t, c, g, unknown or other
  misc_difference 739: note = a, t, c, g, unknown or other
  misc_difference 740: note = a, t, c, g, unknown or other
  misc_difference 741: note = a, t, c, g, unknown or other
  misc_difference 742: note = a, t, c, g, unknown or other
  misc_difference 743: note = a, t, c, g, unknown or other
  misc_difference 744: note = a, t, c, g, unknown or other
  misc_difference 745: note = a, t, c, g, unknown or other
  misc_difference 746: note = a, t, c, g, unknown or other
  misc_difference 747: note = a, t, c, g, unknown or other
  misc_difference 748: note = a, t, c, g, unknown or other
  misc_difference 749: note = a, t, c, g, unknown or other
  misc_difference 750: note = a, t, c, g, unknown or other
  misc_difference 751: note = a, t, c, g, unknown or other
  misc_difference 752: note = a, t, c, g, unknown or other
  misc_difference 753: note = a, t, c, g, unknown or other
  misc_difference 754: note = a, t, c, g, unknown or other
  misc_difference 755: note = a, t, c, g, unknown or other
  misc_difference 756: note = a, t, c, g, unknown or other
  misc_difference 757: note = a, t, c, g, unknown or other
  misc_difference 758: note = a, t, c, g, unknown or other
  misc_difference 759: note = a, t, c, g, unknown or other
  misc_difference 760: note = a, t, c, g, unknown or other
  misc_difference 761: note = a, t, c, g, unknown or other
  misc_difference 762: note = a, t, c, g, unknown or other
  misc_difference 763: note = a, t, c, g, unknown or other
  misc_difference 764: note = a, t, c, g, unknown or other
  misc_difference 765: note = a, t, c, g, unknown or other
  misc_difference 766: note = a, t, c, g, unknown or other
  misc_difference 767: note = a, t, c, g, unknown or other
  misc_difference 768: note = a, t, c, g, unknown or other
  misc_difference 769: note = a, t, c, g, unknown or other
  misc_difference 770: note = a, t, c, g, unknown or other
  misc_difference 771: note = a, t, c, g, unknown or other
  misc_difference 772: note = a, t, c, g, unknown or other
  misc_difference 773: note = a, t, c, g, unknown or other
  misc_difference 774: note = a, t, c, g, unknown or other
  misc_difference 775: note = a, t, c, g, unknown or other
  misc_difference 776: note = a, t, c, g, unknown or other
  misc_difference 777: note = a, t, c, g, unknown or other
  misc_difference 778: note = a, t, c, g, unknown or other
  misc_difference 779: note = a, t, c, g, unknown or other
  misc_difference 780: note = a, t, c, g, unknown or other
  misc_difference 781: note = a, t, c, g, unknown or other
  misc_difference 782: note = a, t, c, g, unknown or other
  misc_difference 783: note = a, t, c, g, unknown or other
  misc_difference 784: note = a, t, c, g, unknown or other
  misc_difference 785: note = a, t, c, g, unknown or other
  misc_difference 786: note = a, t, c, g, unknown or other
  misc_difference 787: note = a, t, c, g, unknown or other
  misc_difference 788: note = a, t, c, g, unknown or other
  misc_difference 789: note = a, t, c, g, unknown or other
  misc_difference 790: note = a, t, c, g, unknown or other
  misc_difference 791: note = a, t, c, g, unknown or other
  misc_difference 792: note = a, t, c, g, unknown or other
  misc_difference 793: note = a, t, c, g, unknown or other
  misc_difference 794: note = a, t, c, g, unknown or other
  misc_difference 795: note = a, t, c, g, unknown or other
  misc_difference 796: note = a, t, c, g, unknown or other
  misc_difference 797: note = a, t, c, g, unknown or other
  misc_difference 798: note = a, t, c, g, unknown or other
  misc_difference 799: note = a, t, c, g, unknown or other
  misc_difference 800: note = a, t, c, g, unknown or other
  misc_difference 801: note = a, t, c, g, unknown or other
  misc_difference 802: note = a, t, c, g, unknown or other
  misc_difference 803: note = a, t, c, g, unknown or other
  misc_difference 804: note = a, t, c, g, unknown or other
  misc_difference 805: note = a, t, c, g, unknown or other
  misc_difference 806: note = a, t, c, g, unknown or other
  misc_difference 807: note = a, t, c, g, unknown or other
  misc_difference 808: note = a, t, c, g, unknown or other
  misc_difference 809: note = a, t, c, g, unknown or other
  misc_difference 810: note = a, t, c, g, unknown or other
  misc_difference 811: note = a, t, c, g, unknown or other
  misc_difference 812: note = a, t, c, g, unknown or other
  misc_difference 813: note = a, t, c, g, unknown or other
  misc_difference 814: note = a, t, c, g, unknown or other
  misc_difference 815: note = a, t, c, g, unknown or other
  misc_difference 816: note = a, t, c, g, unknown or other
  misc_difference 817: note = a, t, c, g, unknown or other
  misc_difference 818: note = a, t, c, g, unknown or other
  misc_difference 819: note = a, t, c, g, unknown or other
  misc_difference 820: note = a, t, c, g, unknown or other
  misc_difference 821: note = a, t, c, g, unknown or other
  misc_difference 822: note = a, t, c, g, unknown or other
  misc_difference 823: note = a, t, c, g, unknown or other
  misc_difference 824: note = a, t, c, g, unknown or other
  misc_difference 825: note = a, t, c, g, unknown or other
  misc_difference 826: note = a, t, c, g, unknown or other
  misc_difference 827: note = a, t, c, g, unknown or other
  misc_difference 828: note = a, t, c, g, unknown or other
  misc_difference 829: note = a, t, c, g, unknown or other
  misc_difference 830: note = a, t, c, g, unknown or other
  misc_difference 831: note = a, t, c, g, unknown or other
  misc_difference 832: note = a, t, c, g, unknown or other
  misc_difference 833: note = a, t, c, g, unknown or other
  misc_difference 834: note = a, t, c, g, unknown or other
  misc_difference 835: note = a, t, c, g, unknown or other
  misc_difference 836: note = a, t, c, g, unknown or other
  misc_difference 837: note = a, t, c, g, unknown or other
  misc_difference 838: note = a, t, c, g, unknown or other
  misc_difference 839: note = a, t, c, g, unknown or other
  misc_difference 840: note = a, t, c, g, unknown or other
  misc_difference 841: note = a, t, c, g, unknown or other
  misc_difference 842: note = a, t, c, g, unknown or other
  misc_difference 843: note = a, t, c, g, unknown or other
  misc_difference 844: note = a, t, c, g, unknown or other
  misc_difference 845: note = a, t, c, g, unknown or other
  misc_difference 846: note = a, t, c, g, unknown or other
  misc_difference 847: note = a, t, c, g, unknown or other
  misc_difference 848: note = a, t, c, g, unknown or other
  misc_difference 849: note = a, t, c, g, unknown or other
  misc_difference 850: note = a, t, c, g, unknown or other
  misc_difference 851: note = a, t, c, g, unknown or other
  misc_difference 852: note = a, t, c, g, unknown or other
  misc_difference 853: note = a, t, c, g, unknown or other
  misc_difference 854: note = a, t, c, g, unknown or other
  misc_difference 855: note = a, t, c, g, unknown or other
  misc_difference 856: note = a, t, c, g, unknown or other
  misc_difference 857: note = a, t, c, g, unknown or other
  misc_difference 858: note = a, t, c, g, unknown or other
  misc_difference 859: note = a, t, c, g, unknown or other
  misc_difference 860: note = a, t, c, g, unknown or other
  misc_difference 861: note = a, t, c, g, unknown or other
  misc_difference 862: note = a, t, c, g, unknown or other
  misc_difference 863: note = a, t, c, g, unknown or other
  misc_difference 864: note = a, t, c, g, unknown or other
  misc_difference 865: note = a, t, c, g, unknown or other
  misc_difference 866: note = a, t, c, g, unknown or other
  misc_difference 867: note = a, t, c, g, unknown or other
  misc_difference 868: note = a, t, c, g, unknown or other
  misc_difference 869: note = a, t, c, g, unknown or other
  misc_difference 870: note = a, t, c, g, unknown or other
  misc_difference 871: note = a, t, c, g, unknown or other
  misc_difference 872: note = a, t, c, g, unknown or other
  misc_difference 873: note = a, t, c, g, unknown or other
  misc_difference 874: note = a, t, c, g, unknown or other
  misc_difference 875: note = a, t, c, g, unknown or other
  misc_difference 876: note = a, t, c, g, unknown or other
  misc_difference 877: note = a, t, c, g, unknown or other
  misc_difference 878: note = a, t, c, g, unknown or other
  misc_difference 879: note = a, t, c, g, unknown or other
  misc_difference 880: note = a, t, c, g, unknown or other
  misc_difference 881: note = a, t, c, g, unknown or other
  misc_difference 882: note = a, t, c, g, unknown or other
  misc_difference 883: note = a, t, c, g, unknown or other
  misc_difference 884: note = a, t, c, g, unknown or other
  misc_difference 885: note = a, t, c, g, unknown or other
  misc_difference 886: note = a, t, c, g, unknown or other
  misc_difference 887: note = a, t, c, g, unknown or other
  misc_difference 888: note = a, t, c, g, unknown or other
  misc_difference 889: note = a, t, c, g, unknown or other
  misc_difference 890: note = a, t, c, g, unknown or other
  misc_difference 891: note = a, t, c, g, unknown or other
  misc_difference 892: note = a, t, c, g, unknown or other
  misc_difference 893: note = a, t, c, g, unknown or other
  misc_difference 894: note = a, t, c, g, unknown or other
  misc_difference 895: note = a, t, c, g, unknown or other
  misc_difference 896: note = a, t, c, g, unknown or other
  misc_difference 897: note = a, t, c, g, unknown or other
  misc_difference 898: note = a, t, c, g, unknown or other
  misc_difference 899: note = a, t, c, g, unknown or other
  misc_difference 900: note = a, t, c, g, unknown or other
  misc_difference 901: note = a, t, c, g, unknown or other
  misc_difference 902: note = a, t, c, g, unknown or other
  misc_difference 903: note = a, t, c, g, unknown or other
  misc_difference 904: note = a, t, c, g, unknown or other
  misc_difference 905: note = a, t, c, g, unknown or other
  misc_difference 906: note = a, t, c, g, unknown or other
  misc_difference 907: note = a, t, c, g, unknown or other
  misc_difference 908: note = a, t, c, g, unknown or other
  misc_difference 909: note = a, t, c, g, unknown or other
  misc_difference 910: note = a, t, c, g, unknown or other
  misc_difference 911: note = a, t, c, g, unknown or other
  misc_difference 912: note = a, t, c, g, unknown or other
  misc_difference 913: note = a, t, c, g, unknown or other
  misc_difference 914: note = a, t, c, g, unknown or other
  misc_difference 915: note = a, t, c, g, unknown or other
  misc_difference 916: note = a, t, c, g, unknown or other
  misc_difference 917: note = a, t, c, g, unknown or other
  misc_difference 918: note = a, t, c, g, unknown or other
  misc_difference 919: note = a, t, c, g, unknown or other
  misc_difference 920: note = a, t, c, g, unknown or other
  misc_difference 921: note = a, t, c, g, unknown or other
  misc_difference 922: note = a, t, c, g, unknown or other
  misc_difference 923: note = a, t, c, g, unknown or other
  misc_difference 924: note = a, t, c, g, unknown or other
  misc_difference 925: note = a, t, c, g, unknown or other
  misc_difference 926: note = a, t, c, g, unknown or other
  misc_difference 927: note = a, t, c, g, unknown or other
  misc_difference 928: note = a, t, c, g, unknown or other
  misc_difference 929: note = a, t, c, g, unknown or other
  misc_difference 930: note = a, t, c, g, unknown or other
  misc_difference 931: note = a, t, c, g, unknown or other
  misc_difference 932: note = a, t, c, g, unknown or other
  misc_difference 933: note = a, t, c, g, unknown or other
  misc_difference 934: note = a, t, c, g, unknown or other
  misc_difference 935: note = a, t, c, g, unknown or other
  misc_difference 936: note = a, t, c, g, unknown or other
  misc_difference 937: note = a, t, c, g, unknown or other
  misc_difference 938: note = a, t, c, g, unknown or other
  misc_difference 939: note = a, t, c, g, unknown or other
  misc_difference 940: note = a, t, c, g, unknown or other
  misc_difference 941: note = a, t, c, g, unknown or other
  misc_difference 942: note = a, t, c, g, unknown or other
  misc_difference 943: note = a, t, c, g, unknown or other
  misc_difference 944: note = a, t, c, g, unknown or other
  misc_difference 945: note = a, t, c, g, unknown or other
  misc_difference 946: note = a, t, c, g, unknown or other
  misc_difference 947: note = a, t, c, g, unknown or other
  misc_difference 948: note = a, t, c, g, unknown or other
  misc_difference 949: note = a, t, c, g, unknown or other
  misc_difference 950: note = a, t, c, g, unknown or other
  misc_difference 951: note = a, t, c, g, unknown or other
  misc_difference 952: note = a, t, c, g, unknown or other
  misc_difference 953: note = a, t, c, g, unknown or other
  misc_difference 954: note = a, t, c, g, unknown or other
  misc_difference 955: note = a, t, c, g, unknown or other
  misc_difference 956: note = a, t, c, g, unknown or other
  misc_difference 957: note = a, t, c, g, unknown or other
  misc_difference 958: note = a, t, c, g, unknown or other
  misc_difference 959: note = a, t, c, g, unknown or other
  misc_difference 960: note = a, t, c, g, unknown or other
  misc_difference 961: note = a, t, c, g, unknown or other
  misc_difference 962: note = a, t, c, g, unknown or other
  misc_difference 963: note = a, t, c, g, unknown or other
  misc_difference 964: note = a, t, c, g, unknown or other
  misc_difference 965: note = a, t, c, g, unknown or other
  misc_difference 966: note = a, t, c, g, unknown or other
  misc_difference 967: note = a, t, c, g, unknown or other
  misc_difference 968: note = a, t, c, g, unknown or other
  misc_difference 969: note = a, t, c, g, unknown or other
  misc_difference 970: note = a, t, c, g, unknown or other
  misc_difference 971: note = a, t, c, g, unknown or other
  misc_difference 972: note = a, t, c, g, unknown or other
  misc_difference 973: note = a, t, c, g, unknown or other
  misc_difference 974: note = a, t, c, g, unknown or other
  misc_difference 975: note = a, t, c, g, unknown or other
  misc_difference 976: note = a, t, c, g, unknown or other
  misc_difference 977: note = a, t, c, g, unknown or other
  misc_difference 978: note = a, t, c, g, unknown or other
  misc_difference 979: note = a, t, c, g, unknown or other
  misc_difference 980: note = a, t, c, g, unknown or other
  misc_difference 981: note = a, t, c, g, unknown or other
  misc_difference 982: note = a, t, c, g, unknown or other
  misc_difference 983: note = a, t, c, g, unknown or other
  misc_difference 984: note = a, t, c, g, unknown or other
  misc_difference 985: note = a, t, c, g, unknown or other
  misc_difference 986: note = a, t, c, g, unknown or other
  misc_difference 987: note = a, t, c, g, unknown or other
  misc_difference 988: note = a, t, c, g, unknown or other
  misc_difference 989: note = a, t, c, g, unknown or other
  misc_difference 990: note = a, t, c, g, unknown or other
  misc_difference 991: note = a, t, c, g, unknown or other
  misc_difference 992: note = a, t, c, g, unknown or other
  misc_difference 993: note = a, t, c, g, unknown or other
  misc_difference 994: note = a, t, c, g, unknown or other
  misc_difference 995: note = a, t, c, g, unknown or other
  misc_difference 996: note = a, t, c, g, unknown or other
  misc_difference 997: note = a, t, c, g, unknown or other
  misc_difference 998: note = a, t, c, g, unknown or other
  misc_difference 999: note = a, t, c, g, unknown or other
  misc_difference 1000: note = a, t, c, g, unknown or other
  misc_difference 1001..1068: note = a, t, c, g, unknown or other
acagtcagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10 - DNA, 1092 bp, synthetic construct
  source 1..1092: mol_type = other DNA
  misc_difference 1: note = a, t, c, g, unknown or other
  misc_difference 2: note = a, t, c, g, unknown or other
  misc_difference 3: note = a, t, c, g, unknown or other
  misc_difference 4: note = a, t, c, g, unknown or other
  misc_difference 5: note = a, t, c, g, unknown or other
  misc_difference 6: note = a, t, c, g, unknown or other
  misc_difference 7: note = a, t, c, g, unknown or other
  misc_difference 8: note = a, t, c, g, unknown or other
  misc_difference 9: note = a, t, c, g, unknown or other
  misc_difference 10: note = a, t, c, g, unknown or other
  misc_difference 11: note = a, t, c, g, unknown or other
  misc_difference 12: note = a, t, c, g, unknown or other
  misc_difference 13: note = a, t, c, g, unknown or other
  misc_difference 14: note = a, t, c, g, unknown or other
  misc_difference 15: note = a, t, c, g, unknown or other
  misc_difference 16: note = a, t, c, g, unknown or other
  misc_difference 17: note = a, t, c, g, unknown or other
  misc_difference 18: note = a, t, c, g, unknown or other
  misc_difference 19: note = a, t, c, g, unknown or other
  misc_difference 20: note = a, t, c, g, unknown or other
  misc_difference 21: note = a, t, c, g, unknown or other
  misc_difference 22: note = a, t, c, g, unknown or other
  misc_difference 23: note = a, t, c, g, unknown or other
  misc_difference 24: note = a, t, c, g, unknown or other
  misc_difference 25: note = a, t, c, g, unknown or other
  misc_difference 26: note = a, t, c, g, unknown or other
  misc_difference 27: note = a, t, c, g, unknown or other
  misc_difference 28: note = a, t, c, g, unknown or other
  misc_difference 29: note = a, t, c, g, unknown or other
  misc_difference 30: note = a, t, c, g, unknown or other
  misc_difference 31: note = a, t, c, g, unknown or other
  misc_difference 32: note = a, t, c, g, unknown or other
  misc_difference 33: note = a, t, c, g, unknown or other
  misc_difference 34: note = a, t, c, g, unknown or other
  misc_difference 35: note = a, t, c, g, unknown or other
  misc_difference 36: note = a, t, c, g, unknown or other
  misc_difference 37: note = a, t, c, g, unknown or other
  misc_difference 38: note = a, t, c, g, unknown or other
  misc_difference 39: note = a, t, c, g, unknown or other
  misc_difference 40: note = a, t, c, g, unknown or other
  misc_difference 41: note = a, t, c, g, unknown or other
  misc_difference 42: note = a, t, c, g, unknown or other
  misc_difference 43: note = a, t, c, g, unknown or other
  misc_difference 44: note = a, t, c, g, unknown or other
  misc_difference 45: note = a, t, c, g, unknown or other
  misc_difference 46: note = a, t, c, g, unknown or other
  misc_difference 47: note = a, t, c, g, unknown or other
  misc_difference 48: note = a, t, c, g, unknown or other
  misc_difference 49: note = a, t, c, g, unknown or other
  misc_difference 50: note = a, t, c, g, unknown or other
  misc_difference 51: note = a, t, c, g, unknown or other
  misc_difference 52: note = a, t, c, g, unknown or other
  misc_difference 53: note = a, t, c, g, unknown or other
  misc_difference 54: note = a, t, c, g, unknown or other
  misc_difference 55: note = a, t, c, g, unknown or other
  misc_difference 56: note = a, t, c, g, unknown or other
  misc_difference 57: note = a, t, c, g, unknown or other
  misc_difference 58: note = a, t, c, g, unknown or other
  misc_difference 59: note = a, t, c, g, unknown or other
  misc_difference 60: note = a, t, c, g, unknown or other
  misc_difference 61: note = a, t, c, g, unknown or other
  misc_difference 62: note = a, t, c, g, unknown or other
  misc_difference 63: note = a, t, c, g, unknown or other
  misc_difference 64: note = a, t, c, g, unknown or other
  misc_difference 65: note = a, t, c, g, unknown or other
  misc_difference 66: note = a, t, c, g, unknown or other
  misc_difference 67: note = a, t, c, g, unknown or other
  misc_difference 68: note = a, t, c, g, unknown or other
  misc_difference 69: note = a, t, c, g, unknown or other
  misc_difference 70: note = a, t, c, g, unknown or other
  misc_difference 71: note = a, t, c, g, unknown or other
  misc_difference 72: note = a, t, c, g, unknown or other
  misc_difference 73: note = a, t, c, g, unknown or other
  misc_difference 74: note = a, t, c, g, unknown or other
  misc_difference 75: note = a, t, c, g, unknown or other
  misc_difference 76: note = a, t, c, g, unknown or other
  misc_difference 77: note = a, t, c, g, unknown or other
  misc_difference 78: note = a, t, c, g, unknown or other
  misc_difference 79: note = a, t, c, g, unknown or other
  misc_difference 80: note = a, t, c, g, unknown or other
  misc_difference 81: note = a, t, c, g, unknown or other
  misc_difference 82: note = a, t, c, g, unknown or other
  misc_difference 83: note = a, t, c, g, unknown or other
  misc_difference 84: note = a, t, c, g, unknown or other
  misc_difference 85: note = a, t, c, g, unknown or other
  misc_difference 86: note = a, t, c, g, unknown or other
  misc_difference 87: note = a, t, c, g, unknown or other
  misc_difference 88: note = a, t, c, g, unknown or other
  misc_difference 89: note = a, t, c, g, unknown or other
  misc_difference 90: note = a, t, c, g, unknown or other
  misc_difference 91: note = a, t, c, g, unknown or other
  misc_difference 92: note = a, t, c, g, unknown or other
  misc_difference 93: note = a, t, c, g, unknown or other
  misc_difference 94: note = a, t, c, g, unknown or other
  misc_difference 95: note = a, t, c, g, unknown or other
  misc_difference 96: note = a, t, c, g, unknown or other
  misc_difference 97: note = a, t, c, g, unknown or other
  misc_difference 98: note = a, t, c, g, unknown or other
  misc_difference 99: note = a, t, c, g, unknown or other
  misc_difference 100: note = a, t, c, g, unknown or other
  misc_difference 101: note = a, t, c, g, unknown or other
  misc_difference 102: note = a, t, c, g, unknown or other
  misc_difference 103: note = a, t, c, g, unknown or other
  misc_difference 104: note = a, t, c, g, unknown or other
  misc_difference 105: note = a, t, c, g, unknown or other
  misc_difference 106: note = a, t, c, g, unknown or other
  misc_difference 107: note = a, t, c, g, unknown or other
  misc_difference 108: note = a, t, c, g, unknown or other
  misc_difference 109: note = a, t, c, g, unknown or other
  misc_difference 110: note = a, t, c, g, unknown or other
  misc_difference 111: note = a, t, c, g, unknown or other
  misc_difference 112: note = a, t, c, g, unknown or other
  misc_difference 113: note = a, t, c, g, unknown or other
  misc_difference 114: note = a, t, c, g, unknown or other
  misc_difference 115: note = a, t, c, g, unknown or other
  misc_difference 116: note = a, t, c, g, unknown or other
  misc_difference 117: note = a, t, c, g, unknown or other
  misc_difference 118: note = a, t, c, g, unknown or other
  misc_difference 119: note = a, t, c, g, unknown or other
  misc_difference 120: note = a, t, c, g, unknown or other
  misc_difference 121: note = a, t, c, g, unknown or other
  misc_difference 122: note = a, t, c, g, unknown or other
  misc_difference 123: note = a, t, c, g, unknown or other
  misc_difference 124: note = a, t, c, g, unknown or other
  misc_difference 125: note = a, t, c, g, unknown or other
  misc_difference 126: note = a, t, c, g, unknown or other
  misc_difference 127: note = a, t, c, g, unknown or other
  misc_difference 128: note = a, t, c, g, unknown or other
  misc_difference 129: note = a, t, c, g, unknown or other
  misc_difference 130: note = a, t, c, g, unknown or other
  misc_difference 131: note = a, t, c, g, unknown or other
  misc_difference 132: note = a, t, c, g, unknown or other
  misc_difference 133: note = a, t, c, g, unknown or other
  misc_difference 134: note = a, t, c, g, unknown or other
  misc_difference 135: note = a, t, c, g, unknown or other
  misc_difference 136: note = a, t, c, g, unknown or other
  misc_difference 137: note = a, t, c, g, unknown or other
  misc_difference 138: note = a, t, c, g, unknown or other
  misc_difference 139: note = a, t, c, g, unknown or other
  misc_difference 140: note = a, t, c, g, unknown or other
  misc_difference 141: note = a, t, c, g, unknown or other
  misc_difference 142: note = a, t, c, g, unknown or other
  misc_difference 143: note = a, t, c, g, unknown or other
  misc_difference 144: note = a, t, c, g, unknown or other
  misc_difference 145: note = a, t, c, g, unknown or other
  misc_difference 146: note = a, t, c, g, unknown or other
  misc_difference 147: note = a, t, c, g, unknown or other
  misc_difference 148: note = a, t, c, g, unknown or other
  misc_difference 149: note = a, t, c, g, unknown or other
  misc_difference 150: note = a, t, c, g, unknown or other
  misc_difference 151: note = a, t, c, g, unknown or other
  misc_difference 152: note = a, t, c, g, unknown or other
  misc_difference 153: note = a, t, c, g, unknown or other
  misc_difference 154: note = a, t, c, g, unknown or other
  misc_difference 155: note = a, t, c, g, unknown or other
  misc_difference 156: note = a, t, c, g, unknown or other
  misc_difference 157: note = a, t, c, g, unknown or other
  misc_difference 158: note = a, t, c, g, unknown or other
  misc_difference 159: note = a, t, c, g, unknown or other
  misc_difference 160: note = a, t, c, g, unknown or other
  misc_difference 161: note = a, t, c, g, unknown or other
  misc_difference 162: note = a, t, c, g, unknown or other
  misc_difference 163: note = a, t, c, g, unknown or other
  misc_difference 164: note = a, t, c, g, unknown or other
  misc_difference 165: note = a, t, c, g, unknown or other
  misc_difference 166: note = a, t, c, g, unknown or other
  misc_difference 167: note = a, t, c, g, unknown or other
  misc_difference 168: note = a, t, c, g, unknown or other
  misc_difference 169: note = a, t, c, g, unknown or other
  misc_difference 170: note = a, t, c, g, unknown or other
  misc_difference 171: note = a, t, c, g, unknown or other
  misc_difference 172: note = a, t, c, g, unknown or other
  misc_difference 173: note = a, t, c, g, unknown or other
  misc_difference 174: note = a, t, c, g, unknown or other
  misc_difference 175: note = a, t, c, g, unknown or other
  misc_difference 176: note = a, t, c, g, unknown or other
  misc_difference 177: note = a, t, c, g, unknown or other
  misc_difference 178: note = a, t, c, g, unknown or other
  misc_difference 179: note = a, t, c, g, unknown or other
  misc_difference 180: note = a, t, c, g, unknown or other
  misc_difference 181: note = a, t, c, g, unknown or other
  misc_difference 182: note = a, t, c, g, unknown or other
  misc_difference 183: note = a, t, c, g, unknown or other
  misc_difference 184: note = a, t, c, g, unknown or other
  misc_difference 185: note = a, t, c, g, unknown or other
  misc_difference 186: note = a, t, c, g, unknown or other
  misc_difference 187: note = a, t, c, g, unknown or other
  misc_difference 188: note = a, t, c, g, unknown or other
  misc_difference 189: note = a, t, c, g, unknown or other
  misc_difference 190: note = a, t, c, g, unknown or other
  misc_difference 191: note = a, t, c, g, unknown or other
  misc_difference 192: note = a, t, c, g, unknown or other
  misc_difference 193: note = a, t, c, g, unknown or other
  misc_difference 194: note = a, t, c, g, unknown or other
  misc_difference 195: note = a, t, c, g, unknown or other
  misc_difference 196: note = a, t, c, g, unknown or other
  misc_difference 197: note = a, t, c, g, unknown or other
  misc_difference 198: note = a, t, c, g, unknown or other
  misc_difference 199: note = a, t, c, g, unknown or other
  misc_difference 200: note = a, t, c, g, unknown or other
  misc_difference 201: note = a, t, c, g, unknown or other
  misc_difference 202: note = a, t, c, g, unknown or other
  misc_difference 203: note = a, t, c, g, unknown or other
  misc_difference 204: note = a, t, c, g, unknown or other
  misc_difference 205: note = a, t, c, g, unknown or other
  misc_difference 206: note = a, t, c, g, unknown or other
  misc_difference 207: note = a, t, c, g, unknown or other
  misc_difference 208: note = a, t, c, g, unknown or other
  misc_difference 209: note = a, t, c, g, unknown or other
  misc_difference 210: note = a, t, c, g, unknown or other
  misc_difference 211: note = a, t, c, g, unknown or other
  misc_difference 212: note = a, t, c, g, unknown or other
  misc_difference 213: note = a, t, c, g, unknown or other
  misc_difference 214: note = a, t, c, g, unknown or other
  misc_difference 215: note = a, t, c, g, unknown or other
  misc_difference 216: note = a, t, c, g, unknown or other
  misc_difference 217: note = a, t, c, g, unknown or other
  misc_difference 218: note = a, t, c, g, unknown or other
  misc_difference 219: note = a, t, c, g, unknown or other
  misc_difference 220: note = a, t, c, g, unknown or other
  misc_difference 221: note = a, t, c, g, unknown or other
  misc_difference 222: note = a, t, c, g, unknown or other
  misc_difference 223: note = a, t, c, g, unknown or other
  misc_difference 224: note = a, t, c, g, unknown or other
  misc_difference 225: note = a, t, c, g, unknown or other
  misc_difference 226: note = a, t, c, g, unknown or other
  misc_difference 227: note = a, t, c, g, unknown or other
  misc_difference 228: note = a, t, c, g, unknown or other
  misc_difference 229: note = a, t, c, g, unknown or other
  misc_difference 230: note = a, t, c, g, unknown or other
  misc_difference 231: note = a, t, c, g, unknown or other
  misc_difference 232: note = a, t, c, g, unknown or other
  misc_difference 233: note = a, t, c, g, unknown or other
  misc_difference 234: note = a, t, c, g, unknown or other
  misc_difference 235: note = a, t, c, g, unknown or other
  misc_difference 236: note = a, t, c, g, unknown or other
  misc_difference 237: note = a, t, c, g, unknown or other
  misc_difference 238: note = a, t, c, g, unknown or other
  misc_difference 239: note = a, t, c, g, unknown or other
  misc_difference 240: note = a, t, c, g, unknown or other
  misc_difference 241: note = a, t, c, g, unknown or other
  misc_difference 242: note = a, t, c, g, unknown or other
  misc_difference 243: note = a, t, c, g, unknown or other
  misc_difference 244: note = a, t, c, g, unknown or other
  misc_difference 245: note = a, t, c, g, unknown or other
  misc_difference 246: note = a, t, c, g, unknown or other
  misc_difference 247: note = a, t, c, g, unknown or other
  misc_difference 248: note = a, t, c, g, unknown or other
  misc_difference 249: note = a, t, c, g, unknown or other
  misc_difference 250: note = a, t, c, g, unknown or other
  misc_difference 251: note = a, t, c, g, unknown or other
  misc_difference 252: note = a, t, c, g, unknown or other
  misc_difference 253: note = a, t, c, g, unknown or other
  misc_difference 254: note = a, t, c, g, unknown or other
  misc_difference 255: note = a, t, c, g, unknown or other
  misc_difference 256: note = a, t, c, g, unknown or other
  misc_difference 257: note = a, t, c, g, unknown or other
  misc_difference 258: note = a, t, c, g, unknown or other
  misc_difference 259: note = a, t, c, g, unknown or other
  misc_difference 260: note = a, t, c, g, unknown or other
  misc_difference 261: note = a, t, c, g, unknown or other
  misc_difference 262: note = a, t, c, g, unknown or other
  misc_difference 263: note = a, t, c, g, unknown or other
  misc_difference 264: note = a, t, c, g, unknown or other
  misc_difference 265: note = a, t, c, g, unknown or other
  misc_difference 266: note = a, t, c, g, unknown or other
  misc_difference 267: note = a, t, c, g, unknown or other
  misc_difference 268: note = a, t, c, g, unknown or other
  misc_difference 269: note = a, t, c, g, unknown or other
  misc_difference 270: note = a, t, c, g, unknown or other
  misc_difference 271: note = a, t, c, g, unknown or other
  misc_difference 272: note = a, t, c, g, unknown or other
  misc_difference 273: note = a, t, c, g, unknown or other
  misc_difference 274: note = a, t, c, g, unknown or other
  misc_difference 275: note = a, t, c, g, unknown or other
  misc_difference 276: note = a, t, c, g, unknown or other
  misc_difference 277: note = a, t, c, g, unknown or other
  misc_difference 278: note = a, t, c, g, unknown or other
  misc_difference 279: note = a, t, c, g, unknown or other
  misc_difference 280: note = a, t, c, g, unknown or other
  misc_difference 281: note = a, t, c, g, unknown or other
  misc_difference 282: note = a, t, c, g, unknown or other
  misc_difference 283: note = a, t, c, g, unknown or other
  misc_difference 284: note = a, t, c, g, unknown or other
  misc_difference 285: note = a, t, c, g, unknown or other
  misc_difference 286: note = a, t, c, g, unknown or other
  misc_difference 287: note = a, t, c, g, unknown or other
  misc_difference 288: note = a, t, c, g, unknown or other
  misc_difference 289: note = a, t, c, g, unknown or other
  misc_difference 290: note = a, t, c, g, unknown or other
  misc_difference 291: note = a, t, c, g, unknown or other
  misc_difference 292: note = a, t, c, g, unknown or other
  misc_difference 293: note = a, t, c, g, unknown or other
  misc_difference 294: note = a, t, c, g, unknown or other
  misc_difference 295: note = a, t, c, g, unknown or other
  misc_difference 296: note = a, t, c, g, unknown or other
  misc_difference 297: note = a, t, c, g, unknown or other
  misc_difference 298: note = a, t, c, g, unknown or other
  misc_difference 299: note = a, t, c, g, unknown or other
  misc_difference 300: note = a, t, c, g, unknown or other
  misc_difference 301: note = a, t, c, g, unknown or other
  misc_difference 302: note = a, t, c, g, unknown or other
  misc_difference 303: note = a, t, c, g, unknown or other
  misc_difference 304: note = a, t, c, g, unknown or other
  misc_difference 305: note = a, t, c, g, unknown or other
  misc_difference 306: note = a, t, c, g, unknown or other
  misc_difference 307: note = a, t, c, g, unknown or other
  misc_difference 308: note = a, t, c, g, unknown or other
  misc_difference 309: note = a, t, c, g, unknown or other
  misc_difference 310: note = a, t, c, g, unknown or other
  misc_difference 311: note = a, t, c, g, unknown or other
  misc_difference 312: note = a, t, c, g, unknown or other
  misc_difference 313: note = a, t, c, g, unknown or other
  misc_difference 314: note = a, t, c, g, unknown or other
  misc_difference 315: note = a, t, c, g, unknown or other
  misc_difference 316: note = a, t, c, g, unknown or other
  misc_difference 317: note = a, t, c, g, unknown or other
  misc_difference 318: note = a, t, c, g, unknown or other
  misc_difference 319: note = a, t, c, g, unknown or other
  misc_difference 320: note = a, t, c, g, unknown or other
  misc_difference 321: note = a, t, c, g, unknown or other
  misc_difference 322: note = a, t, c, g, unknown or other
  misc_difference 323: note = a, t, c, g, unknown or other
  misc_difference 324: note = a, t, c, g, unknown or other
  misc_difference 325: note = a, t, c, g, unknown or other
  misc_difference 326: note = a, t, c, g, unknown or other
  misc_difference 327: note = a, t, c, g, unknown or other
  misc_difference 328: note = a, t, c, g, unknown or other
  misc_difference 329: note = a, t, c, g, unknown or other
  misc_difference 330: note = a, t, c, g, unknown or other
  misc_difference 331: note = a, t, c, g, unknown or other
  misc_difference 332: note = a, t, c, g, unknown or other
  misc_difference 333: note = a, t, c, g, unknown or other
  misc_difference 334: note = a, t, c, g, unknown or other
  misc_difference 335: note = a, t, c, g, unknown or other
  misc_difference 336: note = a, t, c, g, unknown or other
  misc_difference 337: note = a, t, c, g, unknown or other
  misc_difference 338: note = a, t, c, g, unknown or other
  misc_difference 339: note = a, t, c, g, unknown or other
  misc_difference 340: note = a, t, c, g, unknown or other
  misc_difference 341: note = a, t, c, g, unknown or other
  misc_difference 342: note = a, t, c, g, unknown or other
  misc_difference 343: note = a, t, c, g, unknown or other
  misc_difference 344: note = a, t, c, g, unknown or other
  misc_difference 345: note = a, t, c, g, unknown or other
  misc_difference 346: note = a, t, c, g, unknown or other
  misc_difference 347: note = a, t, c, g, unknown or other
  misc_difference 348: note = a, t, c, g, unknown or other
  misc_difference 349: note = a, t, c, g, unknown or other
  misc_difference 350: note = a, t, c, g, unknown or other
  misc_difference 351: note = a, t, c, g, unknown or other
  misc_difference 352: note = a, t, c, g, unknown or other
  misc_difference 353: note = a, t, c, g, unknown or other
  misc_difference 354: note = a, t, c, g, unknown or other
  misc_difference 355: note = a, t, c, g, unknown or other
  misc_difference 356: note = a, t, c, g, unknown or other
  misc_difference 357: note = a, t, c, g, unknown or other
  misc_difference 358: note = a, t, c, g, unknown or other
  misc_difference 359: note = a, t, c, g, unknown or other
  misc_difference 360: note = a, t, c, g, unknown or other
  misc_difference 361: note = a, t, c, g, unknown or other
  misc_difference 362: note = a, t, c, g, unknown or other
  misc_difference 363: note = a, t, c, g, unknown or other
  misc_difference 364: note = a, t, c, g, unknown or other
  misc_difference 365: note = a, t, c, g, unknown or other
  misc_difference 366: note = a, t, c, g, unknown or other
  misc_difference 367: note = a, t, c, g, unknown or other
  misc_difference 368: note = a, t, c, g, unknown or other
  misc_difference 369: note = a, t, c, g, unknown or other
  misc_difference 370: note = a, t, c, g, unknown or other
  misc_difference 371: note = a, t, c, g, unknown or other
  misc_difference 372: note = a, t, c, g, unknown or other
  misc_difference 373: note = a, t, c, g, unknown or other
  misc_difference 374: note = a, t, c, g, unknown or other
  misc_difference 375: note = a, t, c, g, unknown or other
  misc_difference 376: note = a, t, c, g, unknown or other
  misc_difference 377: note = a, t, c, g, unknown or other
  misc_difference 378: note = a, t, c, g, unknown or other
  misc_difference 379: note = a, t, c, g, unknown or other
  misc_difference 380: note = a, t, c, g, unknown or other
  misc_difference 381: note = a, t, c, g, unknown or other
  misc_difference 382: note = a, t, c, g, unknown or other
  misc_difference 383: note = a, t, c, g, unknown or other
  misc_difference 384: note = a, t, c, g, unknown or other
  misc_difference 385: note = a, t, c, g, unknown or other
  misc_difference 386: note = a, t, c, g, unknown or other
  misc_difference 387: note = a, t, c, g, unknown or other
  misc_difference 388: note = a, t, c, g, unknown or other
  misc_difference 389: note = a, t, c, g, unknown or other
  misc_difference 390: note = a, t, c, g, unknown or other
  misc_difference 391: note = a, t, c, g, unknown or other
  misc_difference 392: note = a, t, c, g, unknown or other
  misc_difference 393: note = a, t, c, g, unknown or other
  misc_difference 394: note = a, t, c, g, unknown or other
  misc_difference 395: note = a, t, c, g, unknown or other
  misc_difference 396: note = a, t, c, g, unknown or other
  misc_difference 397: note = a, t, c, g, unknown or other
  misc_difference 398: note = a, t, c, g, unknown or other
  misc_difference 399: note = a, t, c, g, unknown or other
  misc_difference 400: note = a, t, c, g, unknown or other
  misc_difference 401: note = a, t, c, g, unknown or other
  misc_difference 402: note = a, t, c, g, unknown or other
  misc_difference 403: note = a, t, c, g, unknown or other
  misc_difference 404: note = a, t, c, g, unknown or other
  misc_difference 405: note = a, t, c, g, unknown or other
  misc_difference 406: note = a, t, c, g, unknown or other
  misc_difference 407: note = a, t, c, g, unknown or other
  misc_difference 408: note = a, t, c, g, unknown or other
  misc_difference 409: note = a, t, c, g, unknown or other
  misc_difference 410: note = a, t, c, g, unknown or other
  misc_difference 411: note = a, t, c, g, unknown or other
  misc_difference 412: note = a, t, c, g, unknown or other
  misc_difference 413: note = a, t, c, g, unknown or other
  misc_difference 414: note = a, t, c, g, unknown or other
  misc_difference 415: note = a, t, c, g, unknown or other
  misc_difference 416: note = a, t, c, g, unknown or other
  misc_difference 417: note = a, t, c, g, unknown or other
  misc_difference 418: note = a, t, c, g, unknown or other
  misc_difference 419: note = a, t, c, g, unknown or other
  misc_difference 420: note = a, t, c, g, unknown or other
  misc_difference 421: note = a, t, c, g, unknown or other
  misc_difference 422: note = a, t, c, g, unknown or other
  misc_difference 423: note = a, t, c, g, unknown or other
  misc_difference 424: note = a, t, c, g, unknown or other
  misc_difference 425: note = a, t, c, g, unknown or other
  misc_difference 426: note = a, t, c, g, unknown or other
  misc_difference 427: note = a, t, c, g, unknown or other
  misc_difference 428: note = a, t, c, g, unknown or other
  misc_difference 429: note = a, t, c, g, unknown or other
  misc_difference 430: note = a, t, c, g, unknown or other
  misc_difference 431: note = a, t, c, g, unknown or other
  misc_difference 432: note = a, t, c, g, unknown or other
  misc_difference 433: note = a, t, c, g, unknown or other
  misc_difference 434: note = a, t, c, g, unknown or other
  misc_difference 435: note = a, t, c, g, unknown or other
  misc_difference 436: note = a, t, c, g, unknown or other
  misc_difference 437: note = a, t, c, g, unknown or other
  misc_difference 438: note = a, t, c, g, unknown or other
  misc_difference 439: note = a, t, c, g, unknown or other
  misc_difference 440: note = a, t, c, g, unknown or other
  misc_difference 441: note = a, t, c, g, unknown or other
  misc_difference 442: note = a, t, c, g, unknown or other
  misc_difference 443: note = a, t, c, g, unknown or other
  misc_difference 444: note = a, t, c, g, unknown or other
  misc_difference 445: note = a, t, c, g, unknown or other
  misc_difference 446: note = a, t, c, g, unknown or other
  misc_difference 447: note = a, t, c, g, unknown or other
  misc_difference 448: note = a, t, c, g, unknown or other
  misc_difference 449: note = a, t, c, g, unknown or other
  misc_difference 450: note = a, t, c, g, unknown or other
  misc_difference 451: note = a, t, c, g, unknown or other
  misc_difference 452: note = a, t, c, g, unknown or other
  misc_difference 453: note = a, t, c, g, unknown or other
  misc_difference 454: note = a, t, c, g, unknown or other
  misc_difference 455: note = a, t, c, g, unknown or other
  misc_difference 456: note = a, t, c, g, unknown or other
  misc_difference 457: note = a, t, c, g, unknown or other
  misc_difference 458: note = a, t, c, g, unknown or other
  misc_difference 459: note = a, t, c, g, unknown or other
  misc_difference 460: note = a, t, c, g, unknown or other
  misc_difference 461: note = a, t, c, g, unknown or other
  misc_difference 462: note = a, t, c, g, unknown or other
  misc_difference 463: note = a, t, c, g, unknown or other
  misc_difference 464: note = a, t, c, g, unknown or other
  misc_difference 465: note = a, t, c, g, unknown or other
  misc_difference 466: note = a, t, c, g, unknown or other
  misc_difference 467: note = a, t, c, g, unknown or other
  misc_difference 468: note = a, t, c, g, unknown or other
  misc_difference 469: note = a, t, c, g, unknown or other
  misc_difference 470: note = a, t, c, g, unknown or other
  misc_difference 471: note = a, t, c, g, unknown or other
  misc_difference 472: note = a, t, c, g, unknown or other
  misc_difference 473: note = a, t, c, g, unknown or other
  misc_difference 474: note = a, t, c, g, unknown or other
  misc_difference 475: note = a, t, c, g, unknown or other
  misc_difference 476: note = a, t, c, g, unknown or other
  misc_difference 477: note = a, t, c, g, unknown or other
  misc_difference 478: note = a, t, c, g, unknown or other
  misc_difference 479: note = a, t, c, g, unknown or other
  misc_difference 480: note = a, t, c, g, unknown or other
  misc_difference 481: note = a, t, c, g, unknown or other
  misc_difference 482: note = a, t, c, g, unknown or other
  misc_difference 483: note = a, t, c, g, unknown or other
  misc_difference 484: note = a, t, c, g, unknown or other
  misc_difference 485: note = a, t, c, g, unknown or other
  misc_difference 486: note = a, t, c, g, unknown or other
  misc_difference 487: note = a, t, c, g, unknown or other
  misc_difference 488: note = a, t, c, g, unknown or other
  misc_difference 489: note = a, t, c, g, unknown or other
  misc_difference 490: note = a, t, c, g, unknown or other
  misc_difference 491: note = a, t, c, g, unknown or other
  misc_difference 492: note = a, t, c, g, unknown or other
  misc_difference 493: note = a, t, c, g, unknown or other
  misc_difference 494: note = a, t, c, g, unknown or other
  misc_difference 495: note = a, t, c, g, unknown or other
  misc_difference 496: note = a, t, c, g, unknown or other
  misc_difference 497: note = a, t, c, g, unknown or other
  misc_difference 498: note = a, t, c, g, unknown or other
  misc_difference 499: note = a, t, c, g, unknown or other
  misc_difference 500: note = a, t, c, g, unknown or other
  misc_difference 501: note = a, t, c, g, unknown or other
  misc_difference 502: note = a, t, c, g, unknown or other
  misc_difference 503: note = a, t, c, g, unknown or other
  misc_difference 504: note = a, t, c, g, unknown or other
  misc_difference 505: note = a, t, c, g, unknown or other
  misc_difference 506: note = a, t, c, g, unknown or other
  misc_difference 507: note = a, t, c, g, unknown or other
  misc_difference 508: note = a, t, c, g, unknown or other
  misc_difference 509: note = a, t, c, g, unknown or other
  misc_difference 510: note = a, t, c, g, unknown or other
  misc_difference 511: note = a, t, c, g, unknown or other
  misc_difference 512: note = a, t, c, g, unknown or other
  misc_difference 513: note = a, t, c, g, unknown or other
  misc_difference 514: note = a, t, c, g, unknown or other
  misc_difference 515: note = a, t, c, g, unknown or other
  misc_difference 516: note = a, t, c, g, unknown or other
  misc_difference 517: note = a, t, c, g, unknown or other
  misc_difference 518: note = a, t, c, g, unknown or other
  misc_difference 519: note = a, t, c, g, unknown or other
  misc_difference 520: note = a, t, c, g, unknown or other
  misc_difference 521: note = a, t, c, g, unknown or other
  misc_difference 522: note = a, t, c, g, unknown or other
  misc_difference 523: note = a, t, c, g, unknown or other
  misc_difference 524: note = a, t, c, g, unknown or other
  misc_difference 525: note = a, t, c, g, unknown or other
  misc_difference 526: note = a, t, c, g, unknown or other
  misc_difference 527: note = a, t, c, g, unknown or other
  misc_difference 528: note = a, t, c, g, unknown or other
  misc_difference 529: note = a, t, c, g, unknown or other
  misc_difference 530: note = a, t, c, g, unknown or other
  misc_difference 531: note = a, t, c, g, unknown or other
  misc_difference 532: note = a, t, c, g, unknown or other
  misc_difference 533: note = a, t, c, g, unknown or other
  misc_difference 534: note = a, t, c, g, unknown or other
  misc_difference 535: note = a, t, c, g, unknown or other
  misc_difference 536: note = a, t, c, g, unknown or other
  misc_difference 537: note = a, t, c, g, unknown or other
  misc_difference 538: note = a, t, c, g, unknown or other
  misc_difference 539: note = a, t, c, g, unknown or other
  misc_difference 540: note = a, t, c, g, unknown or other
  misc_difference 541: note = a, t, c, g, unknown or other
  misc_difference 542: note = a, t, c, g, unknown or other
  misc_difference 543: note = a, t, c, g, unknown or other
  misc_difference 544: note = a, t, c, g, unknown or other
  misc_difference 545: note = a, t, c, g, unknown or other
  misc_difference 546: note = a, t, c, g, unknown or other
  misc_difference 547: note = a, t, c, g, unknown or other
  misc_difference 548: note = a, t, c, g, unknown or other
  misc_difference 549: note = a, t, c, g, unknown or other
  misc_difference 550: note = a, t, c, g, unknown or other
  misc_difference 551: note = a, t, c, g, unknown or other
  misc_difference 552: note = a, t, c, g, unknown or other
  misc_difference 553: note = a, t, c, g, unknown or other
  misc_difference 554: note = a, t, c, g, unknown or other
  misc_difference 555: note = a, t, c, g, unknown or other
  misc_difference 556: note = a, t, c, g, unknown or other
  misc_difference 557: note = a, t, c, g, unknown or other
  misc_difference 558: note = a, t, c, g, unknown or other
  misc_difference 559: note = a, t, c, g, unknown or other
  misc_difference 560: note = a, t, c, g, unknown or other
  misc_difference 561: note = a, t, c, g, unknown or other
  misc_difference 562: note = a, t, c, g, unknown or other
  misc_difference 563: note = a, t, c, g, unknown or other
  misc_difference 564: note = a, t, c, g, unknown or other
  misc_difference 565: note = a, t, c, g, unknown or other
  misc_difference 566: note = a, t, c, g, unknown or other
  misc_difference 567: note = a, t, c, g, unknown or other
  misc_difference 568: note = a, t, c, g, unknown or other
  misc_difference 569: note = a, t, c, g, unknown or other
  misc_difference 570: note = a, t, c, g, unknown or other
  misc_difference 571: note = a, t, c, g, unknown or other
  misc_difference 572: note = a, t, c, g, unknown or other
  misc_difference 573: note = a, t, c, g, unknown or other
  misc_difference 574: note = a, t, c, g, unknown or other
  misc_difference 575: note = a, t, c, g, unknown or other
  misc_difference 576: note = a, t, c, g, unknown or other
  misc_difference 577: note = a, t, c, g, unknown or other
  misc_difference 578: note = a, t, c, g, unknown or other
  misc_difference 579: note = a, t, c, g, unknown or other
  misc_difference 580: note = a, t, c, g, unknown or other
  misc_difference 581: note = a, t, c, g, unknown or other
  misc_difference 582: note = a, t, c, g, unknown or other
  misc_difference 583: note = a, t, c, g, unknown or other
  misc_difference 584: note = a, t, c, g, unknown or other
  misc_difference 585: note = a, t, c, g, unknown or other
  misc_difference 586: note = a, t, c, g, unknown or other
  misc_difference 587: note = a, t, c, g, unknown or other
  misc_difference 588: note = a, t, c, g, unknown or other
  misc_difference 589: note = a, t, c, g, unknown or other
  misc_difference 590: note = a, t, c, g, unknown or other
  misc_difference 591: note = a, t, c, g, unknown or other
  misc_difference 592: note = a, t, c, g, unknown or other
  misc_difference 593: note = a, t, c, g, unknown or other
  misc_difference 594: note = a, t, c, g, unknown or other
  misc_difference 595: note = a, t, c, g, unknown or other
  misc_difference 596: note = a, t, c, g, unknown or other
  misc_difference 597: note = a, t, c, g, unknown or other
  misc_difference 598: note = a, t, c, g, unknown or other
  misc_difference 599: note = a, t, c, g, unknown or other
  misc_difference 600: note = a, t, c, g, unknown or other
  misc_difference 601: note = a, t, c, g, unknown or other
  misc_difference 602: note = a, t, c, g, unknown or other
  misc_difference 603: note = a, t, c, g, unknown or other
  misc_difference 604: note = a, t, c, g, unknown or other
  misc_difference 605: note = a, t, c, g, unknown or other
  misc_difference 606: note = a, t, c, g, unknown or other
  misc_difference 607: note = a, t, c, g, unknown or other
  misc_difference 608: note = a, t, c, g, unknown or other
  misc_difference 609: note = a, t, c, g, unknown or other
  misc_difference 610: note = a, t, c, g, unknown or other
  misc_difference 611: note = a, t, c, g, unknown or other
  misc_difference 612: note = a, t, c, g, unknown or other
  misc_difference 613: note = a, t, c, g, unknown or other
  misc_difference 614: note = a, t, c, g, unknown or other
  misc_difference 615: note = a, t, c, g, unknown or other
  misc_difference 616: note = a, t, c, g, unknown or other
  misc_difference 617: note = a, t, c, g, unknown or other
  misc_difference 618: note = a, t, c, g, unknown or other
  misc_difference 619: note = a, t, c, g, unknown or other
  misc_difference 620: note = a, t, c, g, unknown or other
  misc_difference 621: note = a, t, c, g, unknown or other
  misc_difference 622: note = a, t, c, g, unknown or other
  misc_difference 623: note = a, t, c, g, unknown or other
  misc_difference 624: note = a, t, c, g, unknown or other
  misc_difference 625: note = a, t, c, g, unknown or other
  misc_difference 626: note = a, t, c, g, unknown or other
  misc_difference 627: note = a, t, c, g, unknown or other
  misc_difference 628: note = a, t, c, g, unknown or other
  misc_difference 629: note = a, t, c, g, unknown or other
  misc_difference 630: note = a, t, c, g, unknown or other
  misc_difference 631: note = a, t, c, g, unknown or other
  misc_difference 632: note = a, t, c, g, unknown or other
  misc_difference 633: note = a, t, c, g, unknown or other
  misc_difference 634: note = a, t, c, g, unknown or other
  misc_difference 635: note = a, t, c, g, unknown or other
  misc_difference 636: note = a, t, c, g, unknown or other
  misc_difference 637: note = a, t, c, g, unknown or other
  misc_difference 638: note = a, t, c, g, unknown or other
  misc_difference 639: note = a, t, c, g, unknown or other
  misc_difference 640: note = a, t, c, g, unknown or other
  misc_difference 641: note = a, t, c, g, unknown or other
  misc_difference 642: note = a, t, c, g, unknown or other
  misc_difference 643: note = a, t, c, g, unknown or other
  misc_difference 644: note = a, t, c, g, unknown or other
  misc_difference 645: note = a, t, c, g, unknown or other
  misc_difference 646: note = a, t, c, g, unknown or other
  misc_difference 647: note = a, t, c, g, unknown or other
  misc_difference 648: note = a, t, c, g, unknown or other
  misc_difference 649: note = a, t, c, g, unknown or other
  misc_difference 650: note = a, t, c, g, unknown or other
  misc_difference 651: note = a, t, c, g, unknown or other
  misc_difference 652: note = a, t, c, g, unknown or other
  misc_difference 653: note = a, t, c, g, unknown or other
  misc_difference 654: note = a, t, c, g, unknown or other
  misc_difference 655: note = a, t, c, g, unknown or other
  misc_difference 656: note = a, t, c, g, unknown or other
  misc_difference 657: note = a, t, c, g, unknown or other
  misc_difference 658: note = a, t, c, g, unknown or other
  misc_difference 659: note = a, t, c, g, unknown or other
  misc_difference 660: note = a, t, c, g, unknown or other
  misc_difference 661: note = a, t, c, g, unknown or other
  misc_difference 662: note = a, t, c, g, unknown or other
  misc_difference 663: note = a, t, c, g, unknown or other
  misc_difference 664: note = a, t, c, g, unknown or other
  misc_difference 665: note = a, t, c, g, unknown or other
  misc_difference 666: note = a, t, c, g, unknown or other
  misc_difference 667: note = a, t, c, g, unknown or other
  misc_difference 668: note = a, t, c, g, unknown or other
  misc_difference 669: note = a, t, c, g, unknown or other
  misc_difference 670: note = a, t, c, g, unknown or other
  misc_difference 671: note = a, t, c, g, unknown or other
  misc_difference 672: note = a, t, c, g, unknown or other
  misc_difference 673: note = a, t, c, g, unknown or other
  misc_difference 674: note = a, t, c, g, unknown or other
  misc_difference 675: note = a, t, c, g, unknown or other
  misc_difference 676: note = a, t, c, g, unknown or other
  misc_difference 677: note = a, t, c, g, unknown or other
  misc_difference 678: note = a, t, c, g, unknown or other
  misc_difference 679: note = a, t, c, g, unknown or other
  misc_difference 680: note = a, t, c, g, unknown or other
  misc_difference 681: note = a, t, c, g, unknown or other
  misc_difference 682: note = a, t, c, g, unknown or other
  misc_difference 683: note = a, t, c, g, unknown or other
  misc_difference 684: note = a, t, c, g, unknown or other
  misc_difference 685: note = a, t, c, g, unknown or other
  misc_difference 686: note = a, t, c, g, unknown or other
  misc_difference 687: note = a, t, c, g, unknown or other
  misc_difference 688: note = a, t, c, g, unknown or other
  misc_difference 689: note = a, t, c, g, unknown or other
  misc_difference 690: note = a, t, c, g, unknown or other
  misc_difference 691: note = a, t, c, g, unknown or other
  misc_difference 692: note = a, t, c, g, unknown or other
  misc_difference 693: note = a, t, c, g, unknown or other
  misc_difference 694: note = a, t, c, g, unknown or other
  misc_difference 695: note = a, t, c, g, unknown or other
  misc_difference 696: note = a, t, c, g, unknown or other
  misc_difference 697: note = a, t, c, g, unknown or other
  misc_difference 698: note = a, t, c, g, unknown or other
  misc_difference 699: note = a, t, c, g, unknown or other
  misc_difference 700: note = a, t, c, g, unknown or other
  misc_difference 701: note = a, t, c, g, unknown or other
  misc_difference 702: note = a, t, c, g, unknown or other
  misc_difference 703: note = a, t, c, g, unknown or other
  misc_difference 704: note = a, t, c, g, unknown or other
  misc_difference 705: note = a, t, c, g, unknown or other
  misc_difference 706: note = a, t, c, g, unknown or other
  misc_difference 707: note = a, t, c, g, unknown or other
  misc_difference 708: note = a, t, c, g, unknown or other
  misc_difference 709: note = a, t, c, g, unknown or other
  misc_difference 710: note = a, t, c, g, unknown or other
  misc_difference 711: note = a, t, c, g, unknown or other
  misc_difference 712: note = a, t, c, g, unknown or other
  misc_difference 713: note = a, t, c, g, unknown or other
  misc_difference 714: note = a, t, c, g, unknown or other
  misc_difference 715: note = a, t, c, g, unknown or other
  misc_difference 716: note = a, t, c, g, unknown or other
  misc_difference 717: note = a, t, c, g, unknown or other
  misc_difference 718: note = a, t, c, g, unknown or other
  misc_difference 719: note = a, t, c, g, unknown or other
  misc_difference 720: note = a, t, c, g, unknown or other
  misc_difference 721: note = a, t, c, g, unknown or other
  misc_difference 722: note = a, t, c, g, unknown or other
  misc_difference 723: note = a, t, c, g, unknown or other
  misc_difference 724: note = a, t, c, g, unknown or other
  misc_difference 725: note = a, t, c, g, unknown or other
  misc_difference 726: note = a, t, c, g, unknown or other
  misc_difference 727: note = a, t, c, g, unknown or other
  misc_difference 728: note = a, t, c, g, unknown or other
  misc_difference 729: note = a, t, c, g, unknown or other
  misc_difference 730: note = a, t, c, g, unknown or other
  misc_difference 731: note = a, t, c, g, unknown or other
  misc_difference 732: note = a, t, c, g, unknown or other
  misc_difference 733: note = a, t, c, g, unknown or other
  misc_difference 734: note = a, t, c, g, unknown or other
  misc_difference 735: note = a, t, c, g, unknown or other
  misc_difference 736: note = a, t, c, g, unknown or other
  misc_difference 737: note = a, t, c, g, unknown or other
  misc_difference 738: note = a, t, c, g, unknown or other
  misc_difference 739: note = a, t, c, g, unknown or other
  misc_difference 740: note = a, t, c, g, unknown or other
  misc_difference 741: note = a, t, c, g, unknown or other
  misc_difference 742: note = a, t, c, g, unknown or other
  misc_difference 743: note = a, t, c, g, unknown or other
  misc_difference 744: note = a, t, c, g, unknown or other
  misc_difference 745: note = a, t, c, g, unknown or other
  misc_difference 746: note = a, t, c, g, unknown or other
  misc_difference 747: note = a, t, c, g, unknown or other
  misc_difference 748: note = a, t, c, g, unknown or other
  misc_difference 749: note = a, t, c, g, unknown or other
  misc_difference 750: note = a, t, c, g, unknown or other
  misc_difference 751: note = a, t, c, g, unknown or other
  misc_difference 752: note = a, t, c, g, unknown or other
  misc_difference 753: note = a, t, c, g, unknown or other
  misc_difference 754: note = a, t, c, g, unknown or other
  misc_difference 755: note = a, t, c, g, unknown or other
  misc_difference 756: note = a, t, c, g, unknown or other
  misc_difference 757: note = a, t, c, g, unknown or other
  misc_difference 758: note = a, t, c, g, unknown or other
  misc_difference 759: note = a, t, c, g, unknown or other
  misc_difference 760: note = a, t, c, g, unknown or other
  misc_difference 761: note = a, t, c, g, unknown or other
  misc_difference 762: note = a, t, c, g, unknown or other
  misc_difference 763: note = a, t, c, g, unknown or other
  misc_difference 764: note = a, t, c, g, unknown or other
  misc_difference 765: note = a, t, c, g, unknown or other
  misc_difference 766: note = a, t, c, g, unknown or other
  misc_difference 767: note = a, t, c, g, unknown or other
  misc_difference 768: note = a, t, c, g, unknown or other
  misc_difference 769: note = a, t, c, g, unknown or other
  misc_difference 770: note = a, t, c, g, unknown or other
  misc_difference 771: note = a, t, c, g, unknown or other
  misc_difference 772: note = a, t, c, g, unknown or other
  misc_difference 773: note = a, t, c, g, unknown or other
  misc_difference 774: note = a, t, c, g, unknown or other
  misc_difference 775: note = a, t, c, g, unknown or other
  misc_difference 776: note = a, t, c, g, unknown or other
  misc_difference 777: note = a, t, c, g, unknown or other
  misc_difference 778: note = a, t, c, g, unknown or other
  misc_difference 779: note = a, t, c, g, unknown or other
  misc_difference 780: note = a, t, c, g, unknown or other
  misc_difference 781: note = a, t, c, g, unknown or other
  misc_difference 782: note = a, t, c, g, unknown or other
  misc_difference 783: note = a, t, c, g, unknown or other
  misc_difference 784: note = a, t, c, g, unknown or other
  misc_difference 785: note = a, t, c, g, unknown or other
  misc_difference 786: note = a, t, c, g, unknown or other
  misc_difference 787: note = a, t, c, g, unknown or other
  misc_difference 788: note = a, t, c, g, unknown or other
  misc_difference 789: note = a, t, c, g, unknown or other
  misc_difference 790: note = a, t, c, g, unknown or other
  misc_difference 791: note = a, t, c, g, unknown or other
  misc_difference 792: note = a, t, c, g, unknown or other
  misc_difference 793: note = a, t, c, g, unknown or other
  misc_difference 794: note = a, t, c, g, unknown or other
  misc_difference 795: note = a, t, c, g, unknown or other
  misc_difference 796: note = a, t, c, g, unknown or other
  misc_difference 797: note = a, t, c, g, unknown or other
  misc_difference 798: note = a, t, c, g, unknown or other
  misc_difference 799: note = a, t, c, g, unknown or other
  misc_difference 800: note = a, t, c, g, unknown or other
  misc_difference 801: note = a, t, c, g, unknown or other
  misc_difference 802: note = a, t, c, g, unknown or other
  misc_difference 803: note = a, t, c, g, unknown or other
  misc_difference 804: note = a, t, c, g, unknown or other
  misc_difference 805: note = a, t, c, g, unknown or other
  misc_difference 806: note = a, t, c, g, unknown or other
  misc_difference 807: note = a, t, c, g, unknown or other
  misc_difference 808: note = a, t, c, g, unknown or other
  misc_difference 809: note = a, t, c, g, unknown or other
  misc_difference 810: note = a, t, c, g, unknown or other
  misc_difference 811: note = a, t, c, g, unknown or other
  misc_difference 812: note = a, t, c, g, unknown or other
  misc_difference 813: note = a, t, c, g, unknown or other
  misc_difference 814: note = a, t, c, g, unknown or other
  misc_difference 815: note = a, t, c, g, unknown or other
  misc_difference 816: note = a, t, c, g, unknown or other
  misc_difference 817: note = a, t, c, g, unknown or other
  misc_difference 818: note = a, t, c, g, unknown or other
  misc_difference 819: note = a, t, c, g, unknown or other
  misc_difference 820: note = a, t, c, g, unknown or other
  misc_difference 821: note = a, t, c, g, unknown or other
  misc_difference 822: note = a, t, c, g, unknown or other
  misc_difference 823: note = a, t, c, g, unknown or other
  misc_difference 824: note = a, t, c, g, unknown or other
  misc_difference 825: note = a, t, c, g, unknown or other
  misc_difference 826: note = a, t, c, g, unknown or other
  misc_difference 827: note = a, t, c, g, unknown or other
  misc_difference 828: note = a, t, c, g, unknown or other
  misc_difference 829: note = a, t, c, g, unknown or other
  misc_difference 830: note = a, t, c, g, unknown or other
  misc_difference 831: note = a, t, c, g, unknown or other
  misc_difference 832: note = a, t, c, g, unknown or other
  misc_difference 833: note = a, t, c, g, unknown or other
  misc_difference 834: note = a, t, c, g, unknown or other
  misc_difference 835: note = a, t, c, g, unknown or other
  misc_difference 836: note = a, t, c, g, unknown or other
  misc_difference 837: note = a, t, c, g, unknown or other
  misc_difference 838: note = a, t, c, g, unknown or other
  misc_difference 839: note = a, t, c, g, unknown or other
  misc_difference 840: note = a, t, c, g, unknown or other
  misc_difference 841: note = a, t, c, g, unknown or other
  misc_difference 842: note = a, t, c, g, unknown or other
  misc_difference 843: note = a, t, c, g, unknown or other
  misc_difference 844: note = a, t, c, g, unknown or other
  misc_difference 845: note = a, t, c, g, unknown or other
  misc_difference 846: note = a, t, c, g, unknown or other
  misc_difference 847: note = a, t, c, g, unknown or other
  misc_difference 848: note = a, t, c, g, unknown or other
  misc_difference 849: note = a, t, c, g, unknown or other
  misc_difference 850: note = a, t, c, g, unknown or other
  misc_difference 851: note = a, t, c, g, unknown or other
  misc_difference 852: note = a, t, c, g, unknown or other
  misc_difference 853: note = a, t, c, g, unknown or other
  misc_difference 854: note = a, t, c, g, unknown or other
  misc_difference 855: note = a, t, c, g, unknown or other
  misc_difference 856: note = a, t, c, g, unknown or other
  misc_difference 857: note = a, t, c, g, unknown or other
  misc_difference 858: note = a, t, c, g, unknown or other
  misc_difference 859: note = a, t, c, g, unknown or other
  misc_difference 860: note = a, t, c, g, unknown or other
  misc_difference 861: note = a, t, c, g, unknown or other
  misc_difference 862: note = a, t, c, g, unknown or other
  misc_difference 863: note = a, t, c, g, unknown or other
  misc_difference 864: note = a, t, c, g, unknown or other
  misc_difference 865: note = a, t, c, g, unknown or other
  misc_difference 866: note = a, t, c, g, unknown or other
  misc_difference 867: note = a, t, c, g, unknown or other
  misc_difference 868: note = a, t, c, g, unknown or other
  misc_difference 869: note = a, t, c, g, unknown or other
  misc_difference 870: note = a, t, c, g, unknown or other
  misc_difference 871: note = a, t, c, g, unknown or other
  misc_difference 872: note = a, t, c, g, unknown or other
  misc_difference 873: note = a, t, c, g, unknown or other
  misc_difference 874: note = a, t, c, g, unknown or other
  misc_difference 875: note = a, t, c, g, unknown or other
  misc_difference 876: note = a, t, c, g, unknown or other
  misc_difference 877: note = a, t, c, g, unknown or other
  misc_difference 878: note = a, t, c, g, unknown or other
  misc_difference 879: note = a, t, c, g, unknown or other
  misc_difference 880: note = a, t, c, g, unknown or other
  misc_difference 881: note = a, t, c, g, unknown or other
  misc_difference 882: note = a, t, c, g, unknown or other
  misc_difference 883: note = a, t, c, g, unknown or other
  misc_difference 884: note = a, t, c, g, unknown or other
  misc_difference 885: note = a, t, c, g, unknown or other
  misc_difference 886: note = a, t, c, g, unknown or other
  misc_difference 887: note = a, t, c, g, unknown or other
  misc_difference 888: note = a, t, c, g, unknown or other
  misc_difference 889: note = a, t, c, g, unknown or other
  misc_difference 890: note = a, t, c, g, unknown or other
  misc_difference 891: note = a, t, c, g, unknown or other
  misc_difference 892: note = a, t, c, g, unknown or other
  misc_difference 893: note = a, t, c, g, unknown or other
  misc_difference 894: note = a, t, c, g, unknown or other
  misc_difference 895: note = a, t, c, g, unknown or other
  misc_difference 896: note = a, t, c, g, unknown or other
  misc_difference 897: note = a, t, c, g, unknown or other
  misc_difference 898: note = a, t, c, g, unknown or other
  misc_difference 899: note = a, t, c, g, unknown or other
  misc_difference 900: note = a, t, c, g, unknown or other
  misc_difference 901: note = a, t, c, g, unknown or other
  misc_difference 902: note = a, t, c, g, unknown or other
  misc_difference 903: note = a, t, c, g, unknown or other
  misc_difference 904: note = a, t, c, g, unknown or other
  misc_difference 905: note = a, t, c, g, unknown or other
  misc_difference 906: note = a, t, c, g, unknown or other
  misc_difference 907: note = a, t, c, g, unknown or other
  misc_difference 908: note = a, t, c, g, unknown or other
  misc_difference 909: note = a, t, c, g, unknown or other
  misc_difference 910: note = a, t, c, g, unknown or other
  misc_difference 911: note = a, t, c, g, unknown or other
  misc_difference 912: note = a, t, c, g, unknown or other
  misc_difference 913: note = a, t, c, g, unknown or other
  misc_difference 914: note = a, t, c, g, unknown or other
  misc_difference 915: note = a, t, c, g, unknown or other
  misc_difference 916: note = a, t, c, g, unknown or other
  misc_difference 917: note = a, t, c, g, unknown or other
  misc_difference 918: note = a, t, c, g, unknown or other
  misc_difference 919: note = a, t, c, g, unknown or other
  misc_difference 920: note = a, t, c, g, unknown or other
  misc_difference 921: note = a, t, c, g, unknown or other
  misc_difference 922: note = a, t, c, g, unknown or other
  misc_difference 923: note = a, t, c, g, unknown or other
  misc_difference 924: note = a, t, c, g, unknown or other
  misc_difference 925: note = a, t, c, g, unknown or other
  misc_difference 926: note = a, t, c, g, unknown or other
  misc_difference 927: note = a, t, c, g, unknown or other
  misc_difference 928: note = a, t, c, g, unknown or other
  misc_difference 929: note = a, t, c, g, unknown or other
  misc_difference 930: note = a, t, c, g, unknown or other
  misc_difference 931: note = a, t, c, g, unknown or other
  misc_difference 932: note = a, t, c, g, unknown or other
  misc_difference 933: note = a, t, c, g, unknown or other
  misc_difference 934: note = a, t, c, g, unknown or other
  misc_difference 935: note = a, t, c, g, unknown or other
  misc_difference 936: note = a, t, c, g, unknown or other
  misc_difference 937: note = a, t, c, g, unknown or other
  misc_difference 938: note = a, t, c, g, unknown or other
  misc_difference 939: note = a, t, c, g, unknown or other
  misc_difference 940: note = a, t, c, g, unknown or other
  misc_difference 941: note = a, t, c, g, unknown or other
  misc_difference 942: note = a, t, c, g, unknown or other
  misc_difference 943: note = a, t, c, g, unknown or other
  misc_difference 944: note = a, t, c, g, unknown or other
  misc_difference 945: note = a, t, c, g, unknown or other
  misc_difference 946: note = a, t, c, g, unknown or other
  misc_difference 947: note = a, t, c, g, unknown or other
  misc_difference 948: note = a, t, c, g, unknown or other
  misc_difference 949: note = a, t, c, g, unknown or other
  misc_difference 950: note = a, t, c, g, unknown or other
  misc_difference 951: note = a, t, c, g, unknown or other
  misc_difference 952: note = a, t, c, g, unknown or other
  misc_difference 953: note = a, t, c, g, unknown or other
  misc_difference 954: note = a, t, c, g, unknown or other
  misc_difference 955: note = a, t, c, g, unknown or other
  misc_difference 956: note = a, t, c, g, unknown or other
  misc_difference 957: note = a, t, c, g, unknown or other
  misc_difference 958: note = a, t, c, g, unknown or other
  misc_difference 959: note = a, t, c, g, unknown or other
  misc_difference 960: note = a, t, c, g, unknown or other
  misc_difference 961: note = a, t, c, g, unknown or other
  misc_difference 962: note = a, t, c, g, unknown or other
  misc_difference 963: note = a, t, c, g, unknown or other
  misc_difference 964: note = a, t, c, g, unknown or other
  misc_difference 965: note = a, t, c, g, unknown or other
  misc_difference 966: note = a, t, c, g, unknown or other
  misc_difference 967: note = a, t, c, g, unknown or other
  misc_difference 968: note = a, t, c, g, unknown or other
  misc_difference 969: note = a, t, c, g, unknown or other
  misc_difference 970: note = a, t, c, g, unknown or other
  misc_difference 971: note = a, t, c, g, unknown or other
  misc_difference 972: note = a, t, c, g, unknown or other
  misc_difference 973: note = a, t, c, g, unknown or other
  misc_difference 974: note = a, t, c, g, unknown or other
  misc_difference 975: note = a, t, c, g, unknown or other
  misc_difference 976: note = a, t, c, g, unknown or other
  misc_difference 977: note = a, t, c, g, unknown or other
  misc_difference 978: note = a, t, c, g, unknown or other
  misc_difference 979: note = a, t, c, g, unknown or other
  misc_difference 980: note = a, t, c, g, unknown or other
  misc_difference 981: note = a, t, c, g, unknown or other
  misc_difference 982: note = a, t, c, g, unknown or other
  misc_difference 983: note = a, t, c, g, unknown or other
  misc_difference 984: note = a, t, c, g, unknown or other
  misc_difference 985: note = a, t, c, g, unknown or other
  misc_difference 986: note = a, t, c, g, unknown or other
  misc_difference 987: note = a, t, c, g, unknown or other
  misc_difference 988: note = a, t, c, g, unknown or other
  misc_difference 989: note = a, t, c, g, unknown or other
  misc_difference 990: note = a, t, c, g, unknown or other
  misc_difference 991..1008: note = a, t, c, g, unknown or other
  misc_difference 1040..1092: note = a, t, c, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtactgactgtagggctggcgaccttgacgannnnnnnnnnnnnnnnnnnnnnnnnnnnnnnnnnnnnnnnnnnnnnnnnnnnn

What is claimed is:

1. A method for processing a nucleic acid sample, comprising:
    (a) providing the nucleic acid sample comprising a first plurality of nucleic acid molecules;
    (b) ligating an adapter to a nucleic acid molecule of the first plurality of nucleic acid molecules, to yield a second plurality of nucleic acid molecules;
    (c) subsequent to (b), subjecting the second plurality of nucleic acid molecules to a thermal treatment, wherein the thermal treatment is sufficient to selectively circularize a nucleic acid molecule of the second plurality of nucleic acid molecules that is smaller than a size threshold to form a circularized nucleic acid molecule, thereby yielding a mixture comprising the circularized nucleic acid molecule and an uncircularized nucleic acid molecule of the second plurality of nucleic acid molecules, wherein the uncircularized nucleic acid molecule is greater than or equal to the size threshold; and
    (d) subsequent to (c), subjecting both of (1) the circularized nucleic acid molecule and (2) the uncircularized nucleic acid molecule to sequencing.

2. The method of claim 1, wherein the size threshold is less than about 3 kilobases (kb).

3. The method of claim 1, wherein the thermal treatment is sufficient to selectively circularize a subpopulation of nucleic acid molecules of the second plurality of nucleic acid molecules, wherein the subpopulation of nucleic acid molecules has an average size that is smaller than the size threshold, to yield the mixture comprising the subpopulation of nucleic acid molecules that are each circularized and an additional subpopulation of nucleic acid molecules that (i) have an average size that is greater than or equal to the size threshold and (ii) are each uncircularized.

4. The method of claim 1, wherein the sequencing of the circularized nucleic acid molecule comprises sequencing-by-synthesis.

5. The method of claim 4, wherein the sequencing of the circularized nucleic acid molecule does not comprise annealing a primer to the circularized nucleic acid molecule.

6. The method of claim 1, wherein the sequencing of the uncircularized nucleic acid molecule comprises annealing a primer to the uncircularized nucleic acid molecule.

7. The method of claim 1, wherein (c) further comprises subjecting the circularized nucleic acid molecule to a ligation reaction.

8. The method of claim 1, wherein the thermal treatment comprises subjecting the second plurality of nucleic acid molecules to heating at a temperature from about 60° C. to about 85° C.

9. The method of claim 1, wherein the thermal treatment comprises subjecting the second plurality of nucleic acid molecules to heating for less than or equal to about 10 minutes.

10. The method of claim 1, wherein the thermal treatment comprises subjecting the second plurality of nucleic acid molecules to cooling at a rate from about 0.1° C./min to about 100° C./min.

11. The method of claim 1, wherein a concentration of the first plurality of nucleic acid molecules is from about 0.01 nM to about 10 nM.

12. The method of claim 1, wherein (i) the circularized nucleic acid molecule comprises the adapter and (ii) the uncircularized nucleic acid molecule comprises the adapter.

13. The method of claim 1, wherein the adapter comprises one or more uracils.

14. The method of claim 1, wherein (b) further comprises ligating an additional adapter to the nucleic acid molecule of the first plurality of nucleic acid molecules.

15. The method of claim 14, wherein the adapter and the additional adapter comprise one or more uracils.

16. The method of claim 15, further comprising, subsequent to the ligating in (b), digesting the one or more uracils in the adapter and the additional adapter, such that a nucleic acid molecule of the second plurality of the nucleic acid molecules comprises a first end and a second end, wherein a portion of the first end is complementary to a portion of the second end.

17. The method of claim 1, further comprising, prior to (b), subjecting the nucleic acid molecule of the first plurality of nucleic acid molecules to polyadenylation.

18. The method of claim 1, wherein the first plurality of nucleic acid molecules has an average size from about 0.1 kb to about 200 kb.

19. The method of claim 1, wherein the second plurality of nucleic acid molecules comprises a plurality of double-stranded nucleic acid molecules.

20. A method for processing a nucleic acid sample, comprising:
  (a) providing the nucleic acid sample comprising a first plurality of nucleic acid molecules;
  (b) ligating an adapter to a nucleic acid molecule of the first plurality of nucleic acid molecules, to yield a second plurality of nucleic acid molecules, wherein the adapter comprises one or more uracils; and
  (c) subsequent to (b), subjecting the second plurality of nucleic acid molecules to a thermal treatment, wherein the thermal treatment is sufficient to selectively circularize a nucleic acid molecule of the second plurality of nucleic acid molecules that is smaller than a size threshold to form a circularized nucleic acid molecule, thereby yielding a mixture comprising the circularized nucleic acid molecule and an uncircularized nucleic acid molecule of the second plurality of nucleic acid molecules, wherein the uncircularized nucleic acid molecule is greater than or equal to the size threshold, wherein both the circularized nucleic acid molecule and the uncircularized nucleic acid molecule are usable for sequencing.

21. The method of claim 20, wherein the size threshold is less than about 3 kilobases (kb).

22. The method of claim 20, wherein (b) further comprises ligating an additional adapter to the nucleic acid molecule of the first plurality of nucleic acid molecules.

23. The method of claim 22, wherein the additional adapter comprise one or more uracils, and wherein the method further comprises, subsequent to the ligating in (b), digesting the one or more uracils in the adapter and the additional adapter, such that a nucleic acid molecule of the second plurality of the nucleic acid molecules comprises a first end and a second end, wherein a portion of the first end is complementary to a portion of the second end.

24. The method of claim 20, wherein (c) further comprises subjecting the circularized nucleic acid molecule to a ligation reaction.

25. The method of claim 20, wherein the thermal treatment comprises subjecting the second plurality of nucleic acid molecules to heating at a temperature from about 60° C. to about 85° C.

26. The method of claim 20, wherein the thermal treatment comprises subjecting the second plurality of nucleic acid molecules to cooling at a rate from about 0.1° C./min to about 100° C./min.

* * * * *